(12) United States Patent
Karow et al.

(10) Patent No.: US 12,060,434 B2
(45) Date of Patent: Aug. 13, 2024

(54) TRISPECIFIC T CELL ENGAGERS

(71) Applicant: Gensun Biopharma Inc., Newbury Park, CA (US)

(72) Inventors: Margaret Karow, Newbury Park, CA (US); Richard Yau, Newbury Park, CA (US); Jackie Sheng, Newbury Park, CA (US)

(73) Assignee: Gensun Biopharma Inc., Newbury Park (CA)

( * ) Notice: Subject to any disclaimer, the term of this patent is extended or adjusted under 35 U.S.C. 154(b) by 317 days.

(21) Appl. No.: 17/164,696

(22) Filed: Feb. 1, 2021

(65) Prior Publication Data

US 2021/0269551 A1 Sep. 2, 2021

Related U.S. Application Data

(60) Provisional application No. 62/981,048, filed on Feb. 25, 2020.

(51) Int. Cl.
| | | |
|---|---|---|
| *C07K 16/30* | (2006.01) | |
| *A61K 39/395* | (2006.01) | |
| *A61K 45/06* | (2006.01) | |
| *C07K 16/28* | (2006.01) | |

(52) U.S. Cl.
CPC .... *C07K 16/3092* (2013.01); *A61K 39/39558* (2013.01); *A61K 45/06* (2013.01); *C07K 16/28* (2013.01); *C07K 16/2809* (2013.01); *C07K 16/2818* (2013.01); *C07K 16/30* (2013.01); *C07K 2317/24* (2013.01); *C07K 2317/31* (2013.01); *C07K 2317/52* (2013.01); *C07K 2317/55* (2013.01); *C07K 2317/622* (2013.01); *C07K 2317/732* (2013.01); *C07K 2317/74* (2013.01); *C07K 2317/75* (2013.01); *C07K 2319/33* (2013.01)

(58) Field of Classification Search
CPC ............... C07K 16/3092; C07K 16/28; A61K 39/39558; A61K 45/06
See application file for complete search history.

(56) References Cited

U.S. PATENT DOCUMENTS

2018/0127489 A1* 5/2018 Sahin ................ A61K 47/6813

FOREIGN PATENT DOCUMENTS

WO    WO-2018191438 A1 * 10/2018 .............. A61P 35/00

OTHER PUBLICATIONS

Rudikoff et al., Single amino acid substitution altering antigen-binding specificity, PNAS, USA, 1982, 79: 1979-1983 (Year: 1982).*
Riemer et al., Matching of trastuzumab (Herceptin®) epitope mimics onto the surface of Her-2/neu—a new method of epitope definition, Mol Immunol, 2005 42(9): 1121-1124 (Year: 2005).*
Wu et al., Building blocks for bispecific and trispecific antibodies, Methods, 154(2019): 3-9, Publication Date: Aug. 30, 2018 (Year: 2018).*

* cited by examiner

*Primary Examiner* — Peter J Reddig
*Assistant Examiner* — Cheng Lu
(74) *Attorney, Agent, or Firm* — Michael Ye; Kalos Athena Wang PLLC

(57) ABSTRACT

Provided are trispecific T Cell Engagers or TSMAb's, antibodies that can simultaneously engage three different types of epitopes on the same target or on different targets. More specifically, the invention is directed to trispecific molecules that bind to DLL3, MUC17 or CLDN18.2 and activate CD (cluster of differentiation) molecules (e.g. CD3, CD28 and CD137). Also provided are methods of treating an ailment such as cancer using an antibody (or fragment) against DLL3, MUC17 or CLD18 paired with an antibody (or fragment) of an agonist antibody that activates CD3, CD28 and/or CD137.

4 Claims, 37 Drawing Sheets

Specification includes a Sequence Listing.

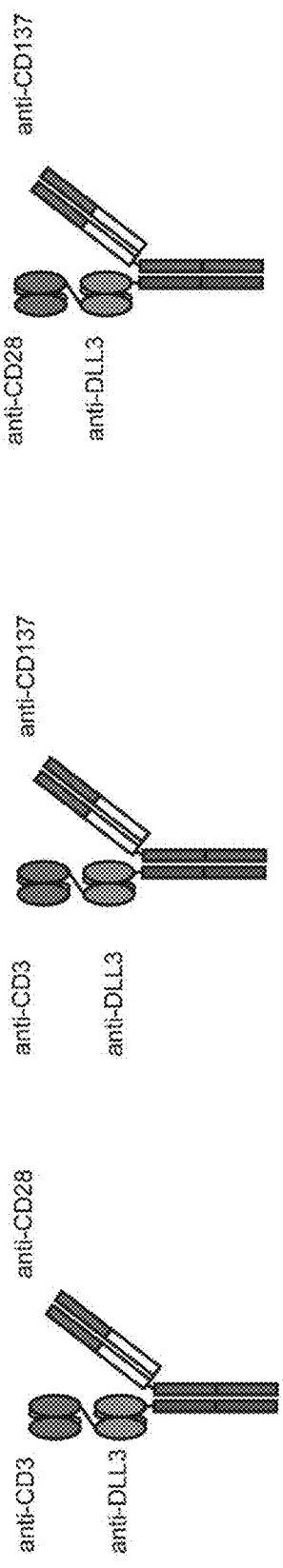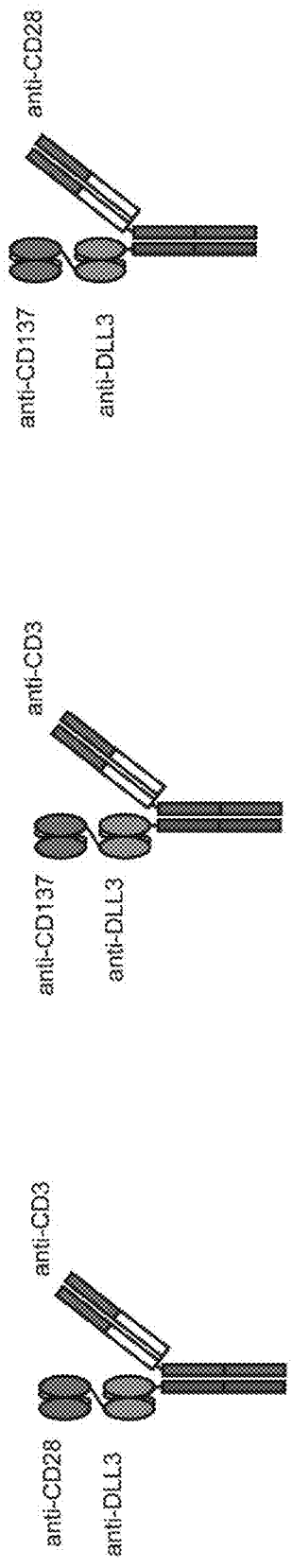
FIG. 1A  FIG. 1B  FIG. 1C  FIG. 1D  FIG. 1E  FIG. 1F

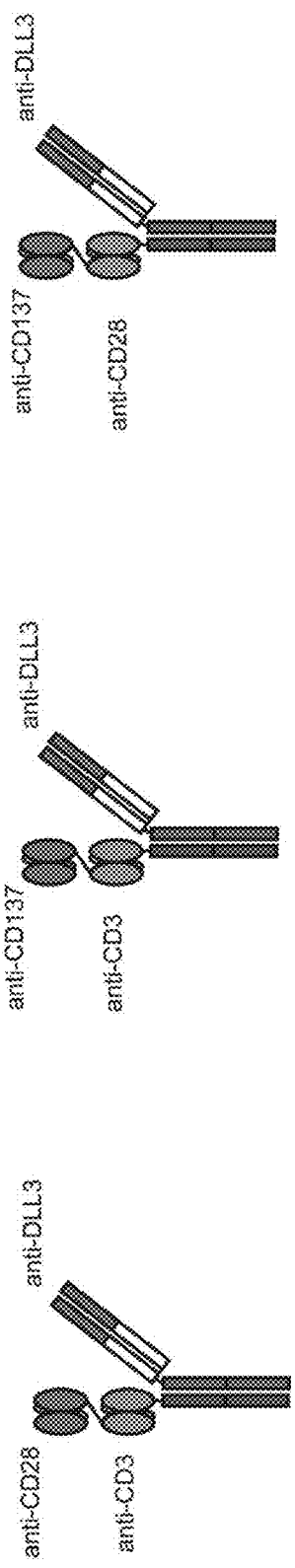
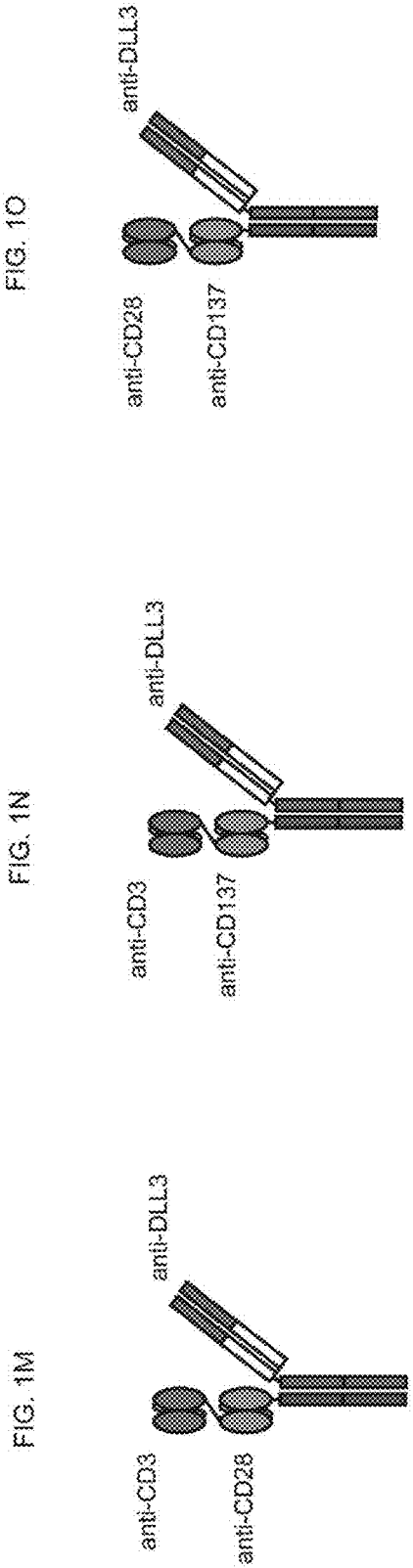
FIG. 1M, FIG. 1N, FIG. 1O, FIG. 1P, FIG. 1Q, FIG. 1R

CD28scfv-CD3scFv-Fc x DLL3-Fab-Fc trispecific molecule 328D3 activates PBMCs to secrete IFN gamma in the presence of CHO-DLL3 cells to higher levels than the CD3scfv-Fc x DLL3Fab-Fc bispecific molecule 3D1I or CD28scfv-Fc x DLL3Fab-Fc bispecific molecule 28D18

CD28scfv-CD3scFv-Fc x DLL3-Fab-Fc trispecific molecule 328D2 activates PBMCs to secrete IFNgamma in the presence of CHO-DLL3 cells to higher levels than the CD3scfv-Fc x DLL3Fab-Fc bispecific molecule 3D4I or CD28scfv-Fc x DLL3Fab-Fc bispecific molecule 28D15

CD28scfv-CD3scFv-Fc x DLL3-Fab-Fc trispecific molecule 328D1 activates PBMCs to secrete IFNgamma in the presence of CHO-DLL3 cells to higher levels than the CD3scfv-Fc x DLL3Fab-Fc bispecific molecule 3D22I or CD28scfv-Fc x DLL3Fab-Fc bispecific molecule 28D17

CD28scfv-CD3scFv-Fc x DLL3-Fab-Fc trispecific molecules 328D4 and 328D5 activate PBMCs to secrete more IL-2 in the presence of NCI-H82 cells greater than the CD3scfv-Fc x DLL3Fab-Fc bispecific, 3D39I Bispecific molecules with two CD137 Fab fragments Bispecific and Trispecific molecules with two Cd137 scfv fragments

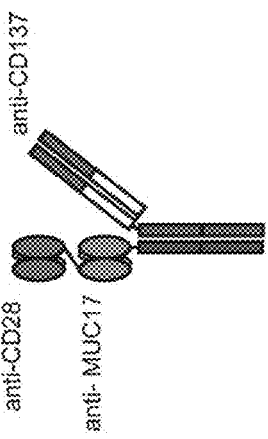
FIG. 10A
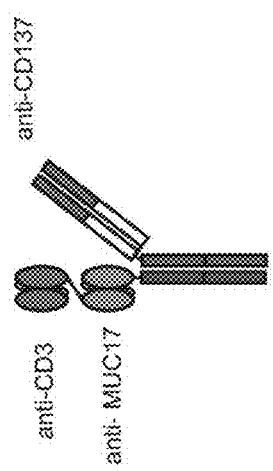
FIG. 10D
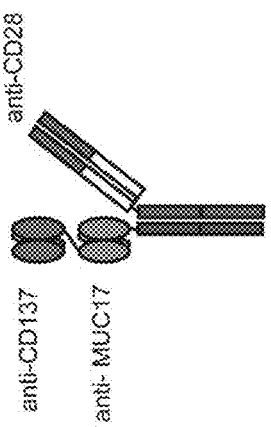
FIG. 10B
FIG. 10C
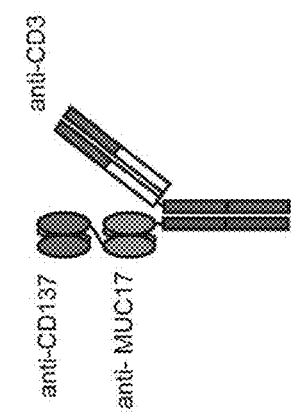
FIG. 10E
FIG. 10F

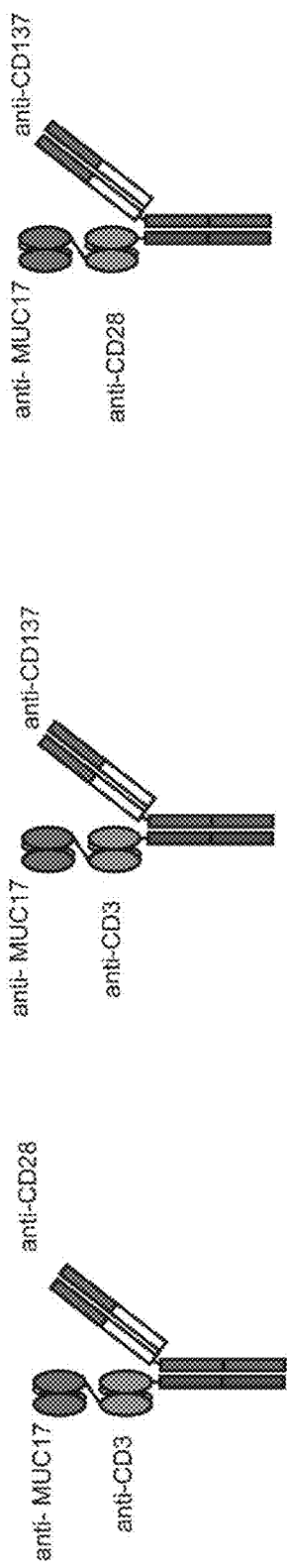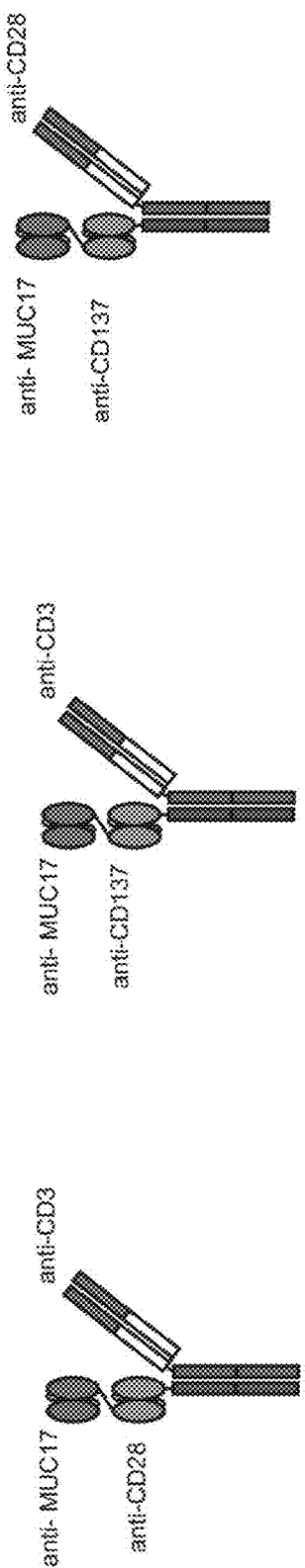
FIG. 10G  FIG. 10H  FIG. 10I
FIG. 10J  FIG. 10K  FIG. 10L

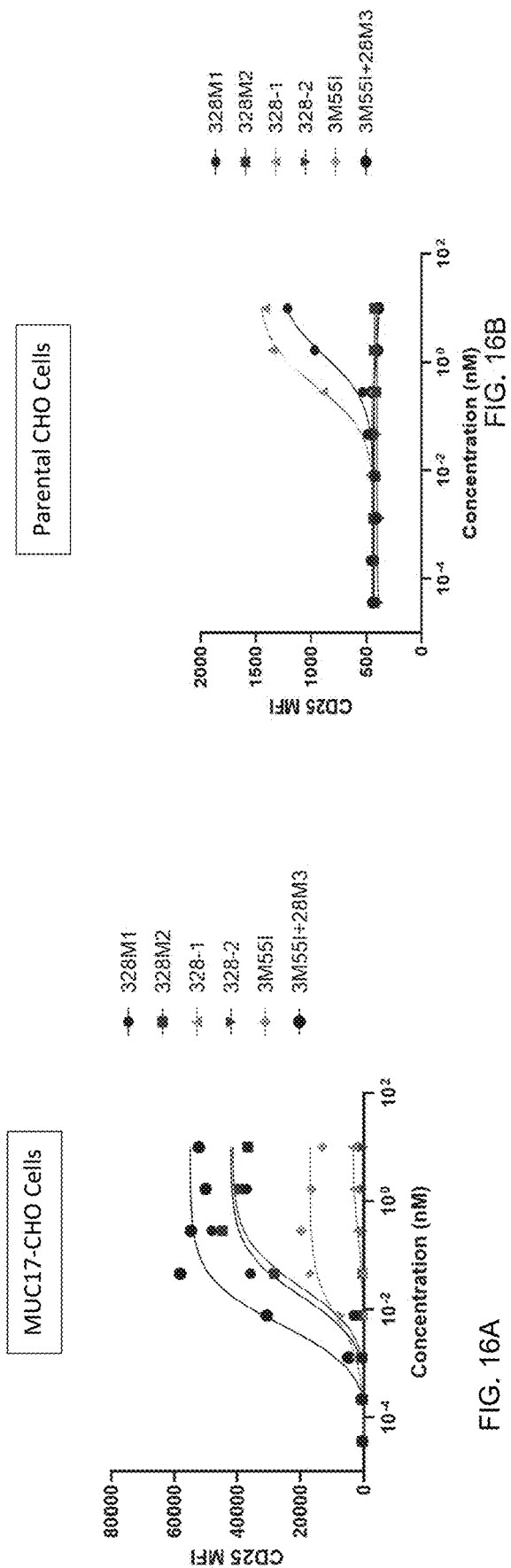

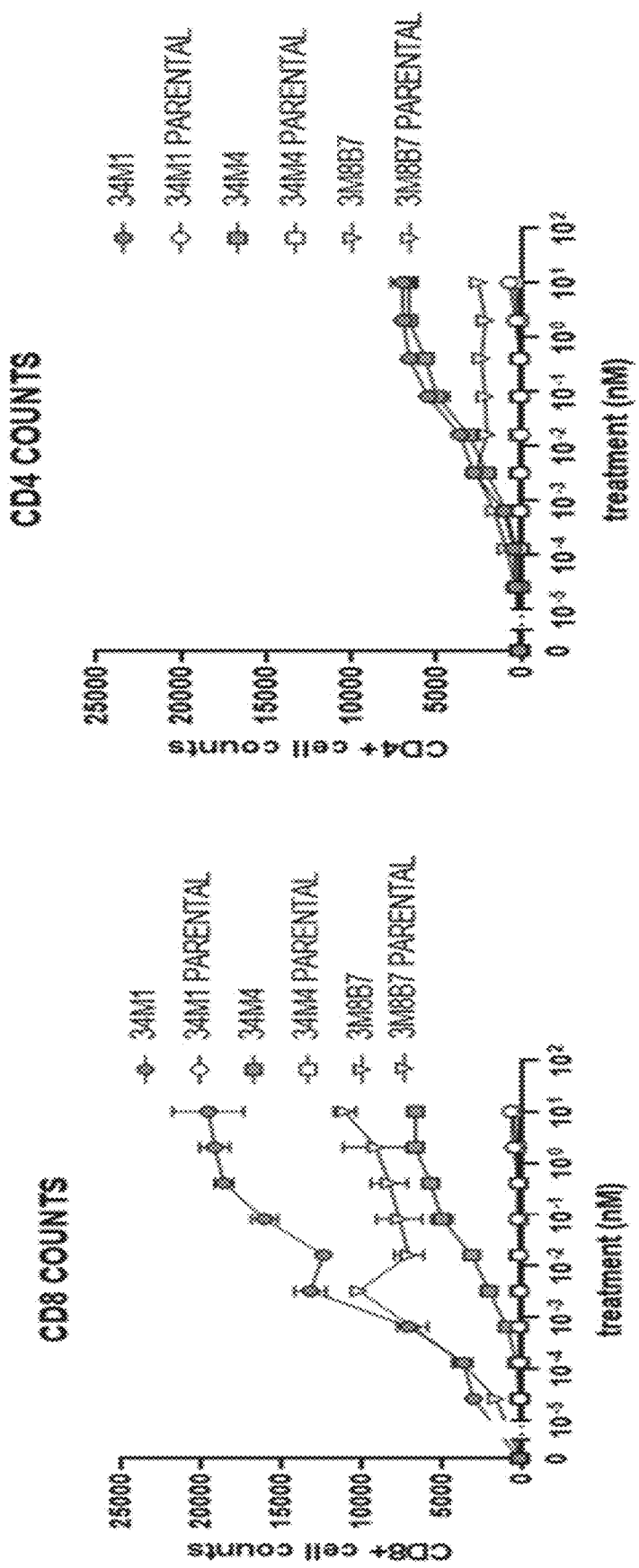

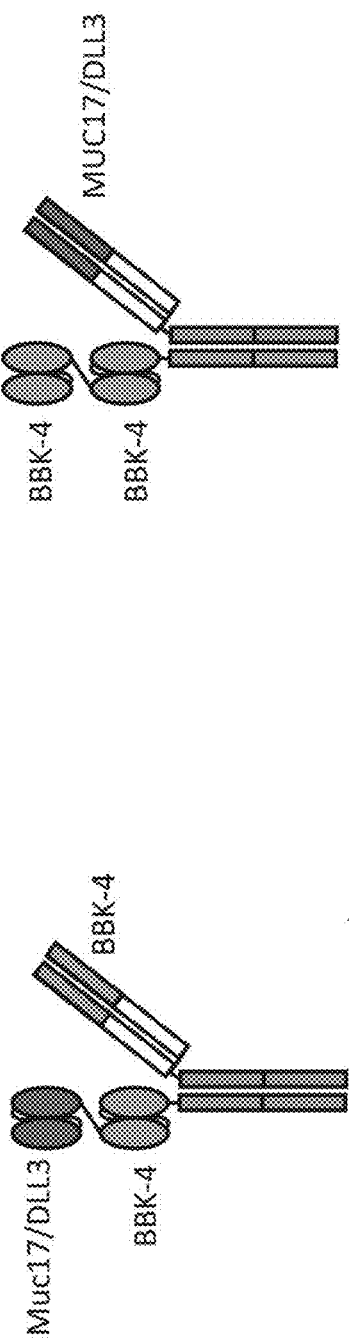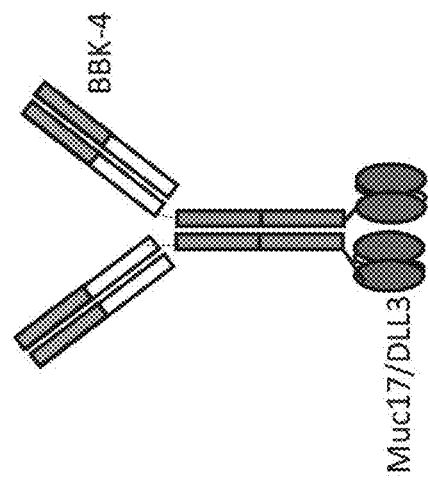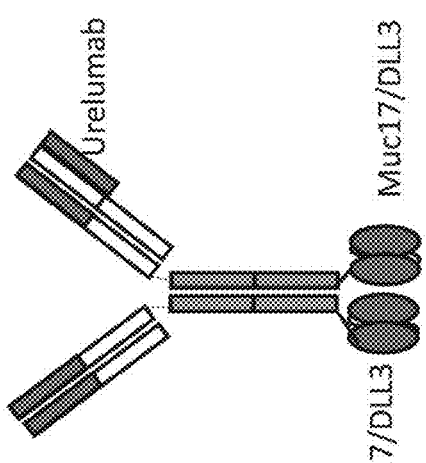

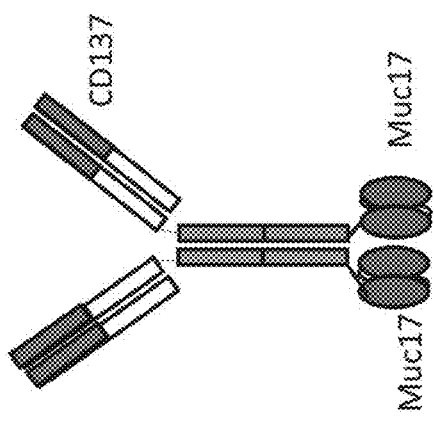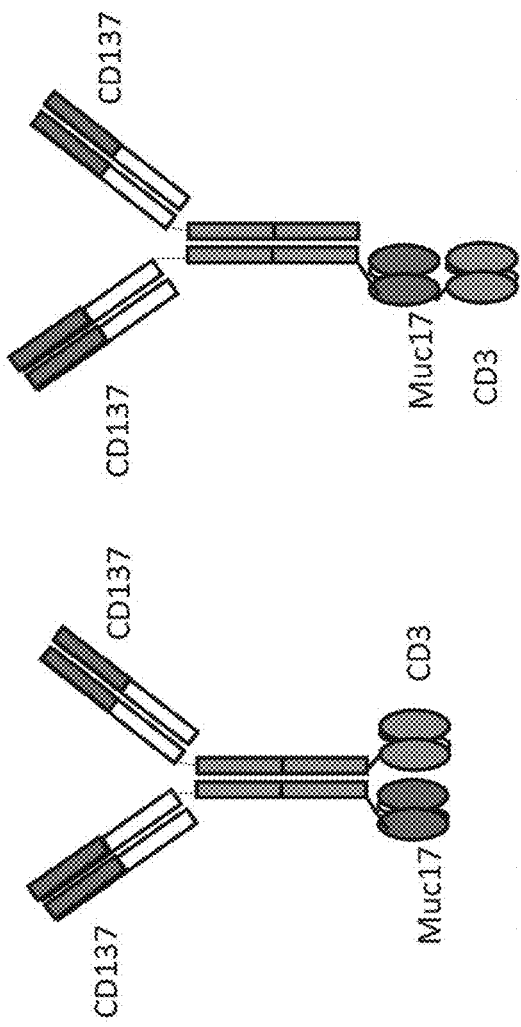

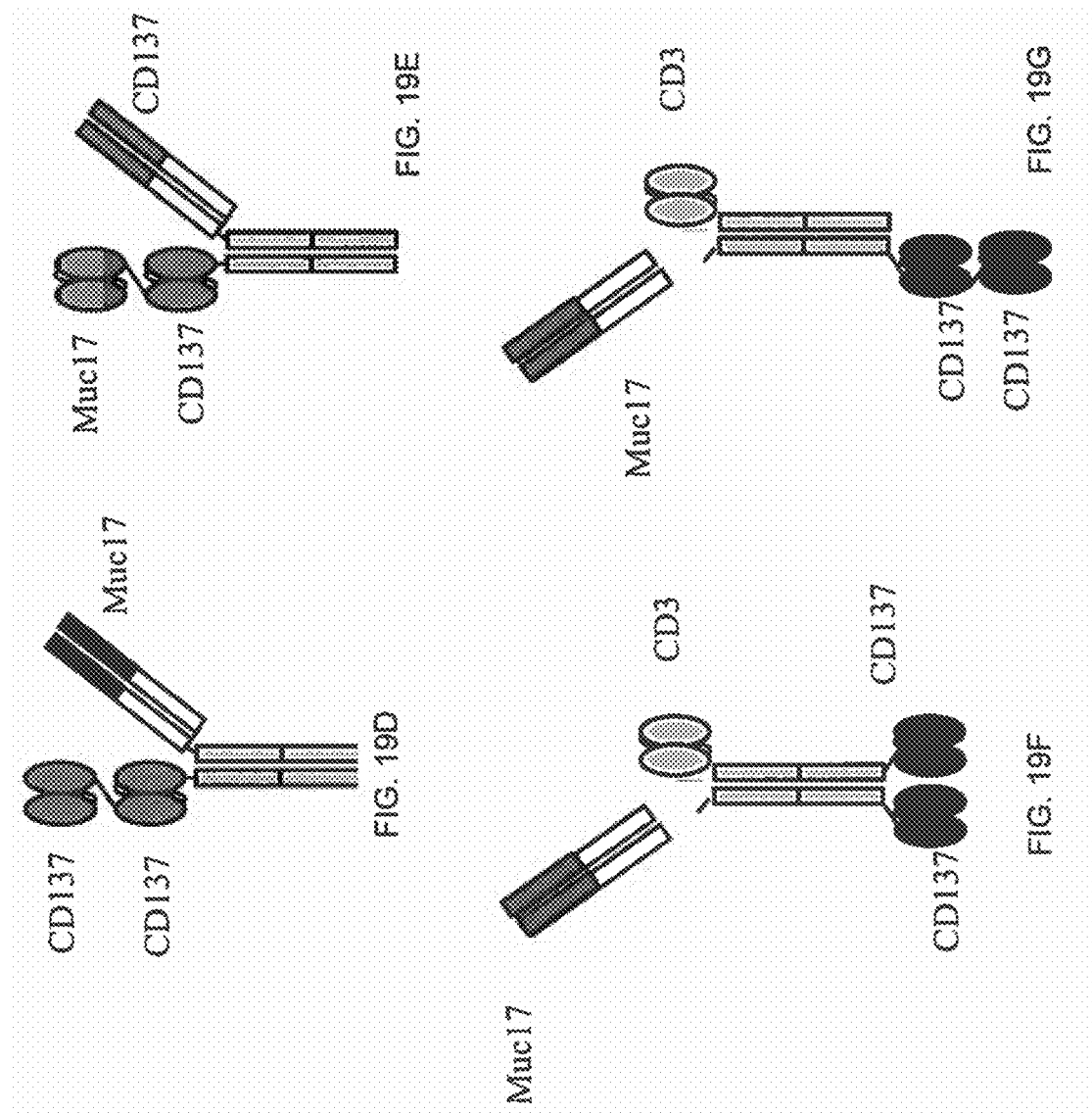

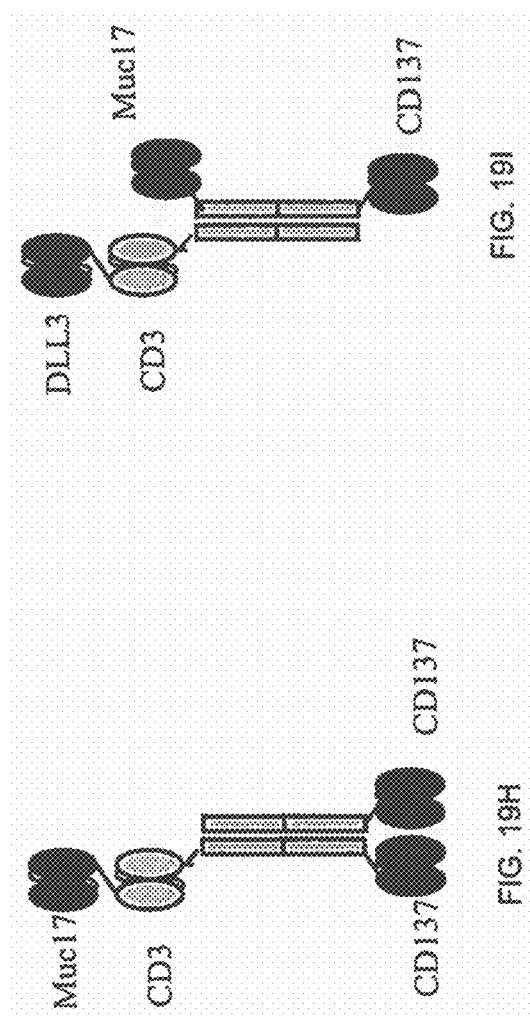

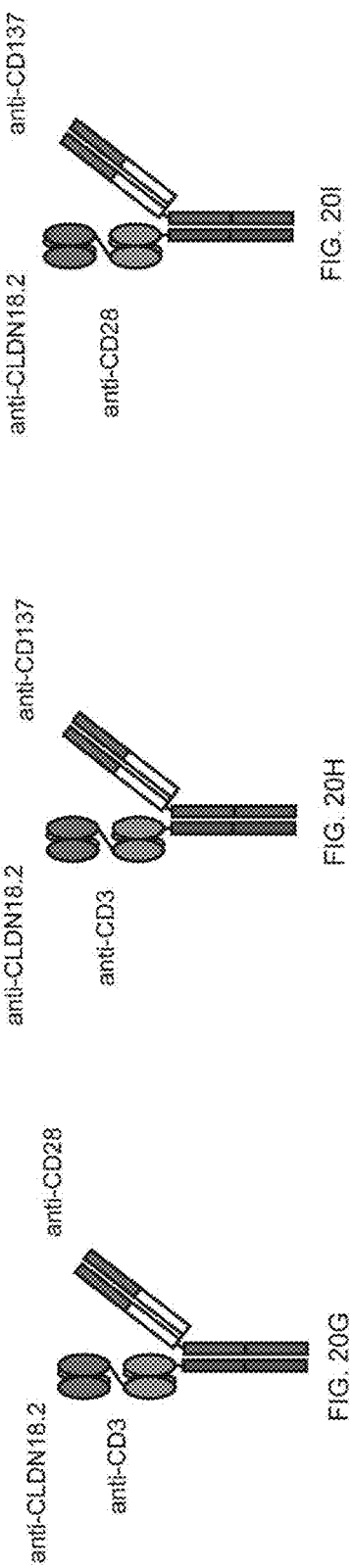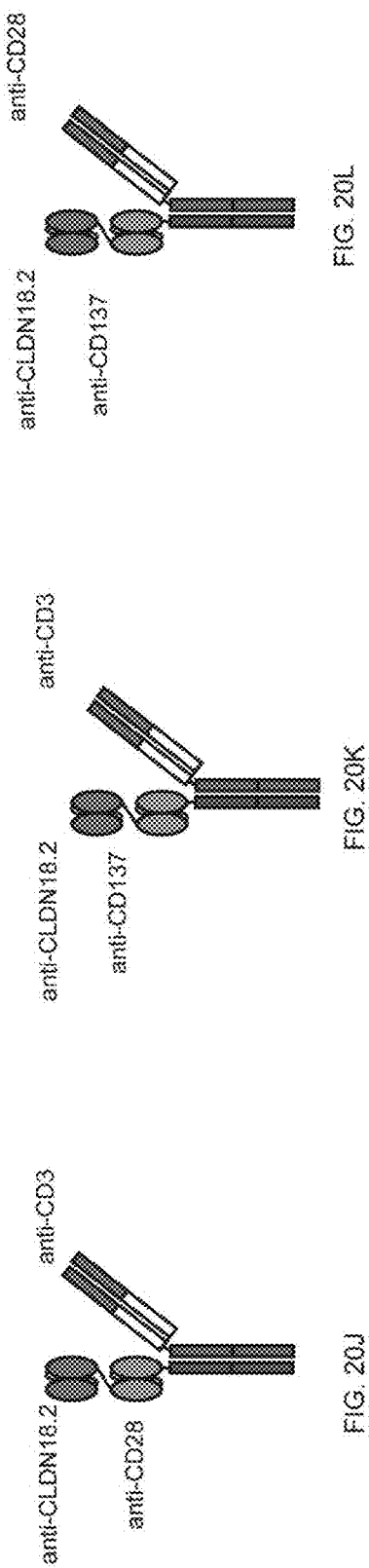

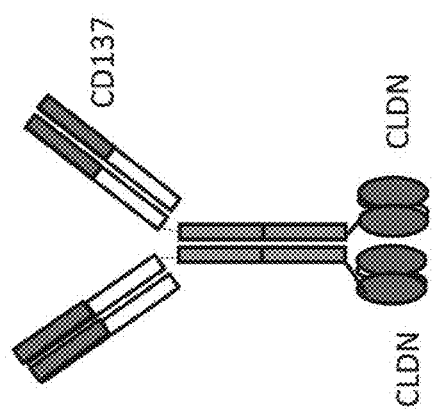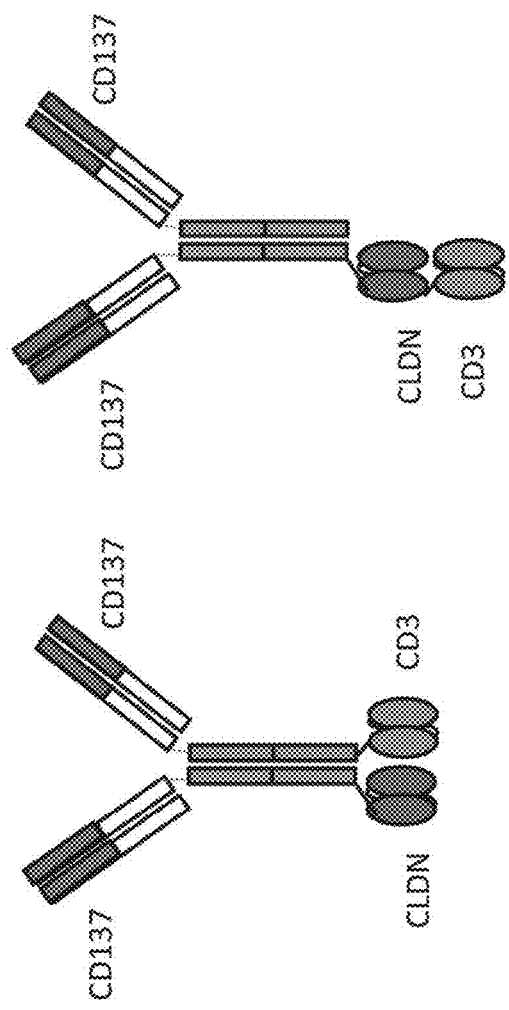
FIG. 25A
FIG. 25B
FIG. 25C

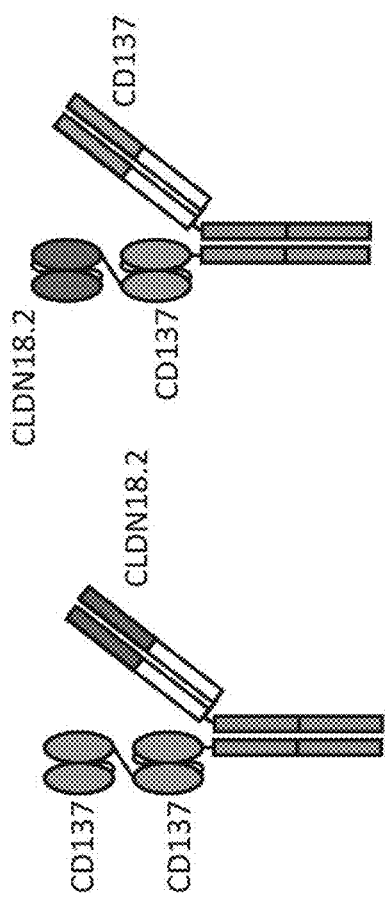

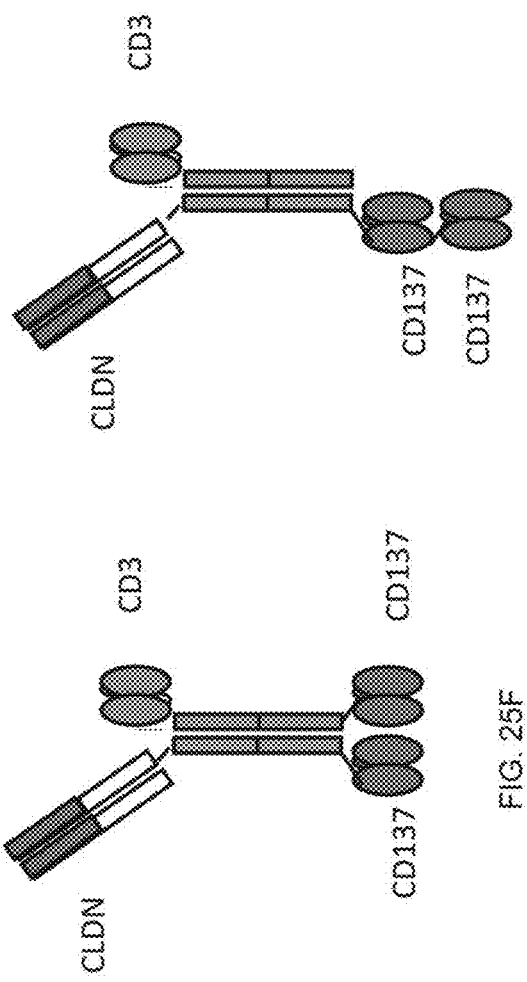

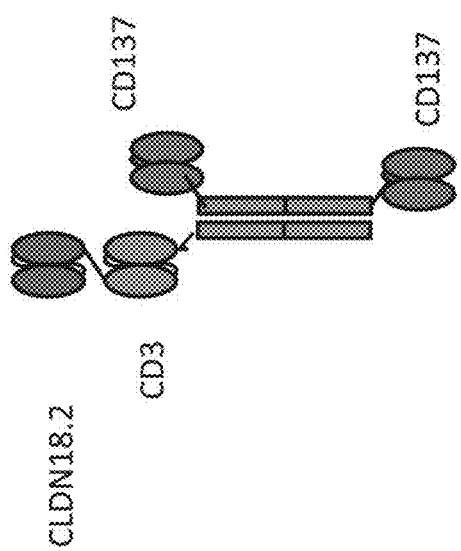
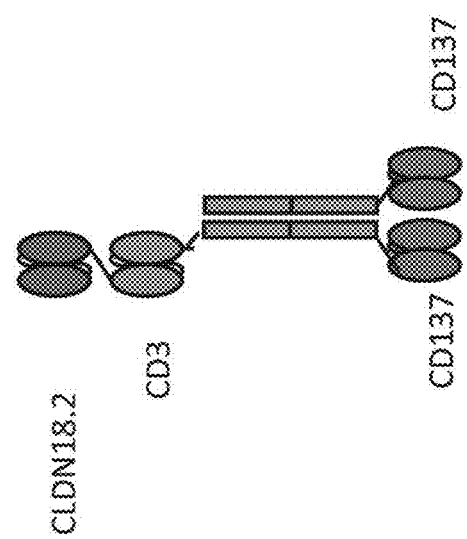
FIG. 25I
FIG. 25H

_US 12,060,434 B2_

TRISPECIFIC T CELL ENGAGERS

RELATED APPLICATIONS

This application claims priority to U.S. provisional patent application Ser. No. 62/968,999 filed on Jan. 31, 2020, U.S. provisional patent application Ser. No. 62/981,048 filed on Feb. 25, 2020 and U.S. provisional patent application Ser. No. 62/991,070 filed on Mar. 17, 2020. The contents of the aforementioned applications are incorporated herein by reference.

REFERENCE TO SEQUENCE LISTING

The instant application contains a Sequence Listing which has been submitted electronically in ASCII format and is hereby incorporated by reference in its entirety. Said ASCII copy, created on Feb. 8, 2024, is named GB1-003US_SL.txt and is 1,132,781 bytes in size.

FIELD OF INVENTION

This invention relates generally to cancer therapies, and more specifically, to novel compounds comprising anti-DLL3, CLDN18.2 and Muc17 antibodies or immunoreactive fragments thereof for the treatment of cancer.

BACKGROUND

Cancer is generally defined as a group of diseases involving abnormal cell growth with the potential to invade or spread to other parts of the body. In 2019, roughly 1.8 million people were diagnosed with cancer in the United States. Each year, an estimated 606,880 people will die from cancer in the United States. Lung and bronchus cancer is responsible for the most deaths. Colorectal cancer and pancreatic cancer are the second and third most common causes of cancer death respectively.

Cancer has been linked to several factors including smoking, obesity, poor diet, lack of physical activity and excessive consumption of alcohol. Other factors include certain infections, exposure to ionizing radiation and environmental pollutants. Certain cancers have been linked to infections such as *Helicobacter pylori*, hepatitis B, hepatitis C, human papillomavirus infection, Epstein-Barr virus and human immunodeficiency virus (HIV).

Conventional cancer treatments are directed at removing cancerous tissue and preventing it from spreading. Such treatment options include surgery, chemotherapy, radiation therapy, hormonal therapy, targeted therapy and palliative care. Treatments are usually pursued based on the type, location and grade of the cancer as well as the patient's health and preferences. These options have limitations. They can be ineffective, particularly when cancer has metastasized. Moreover, chemotherapy and radiation therapy have a range of side-effects related to cell toxicity.

Because cancer cells divide faster than most normal cells, they can be sensitive to chemotherapy drugs. However, chemotherapy drugs will also attack other cells in the body, especially fast-dividing cells such as blood cells and the cells lining the mouth, stomach, and intestines. Accordingly, there is a need for improved medications and methods of treating cancer that are more targeted and have less deleterious side effects.

A promising area for the development of treatments includes targeted therapies using antibodies. For example, the use of antibody drug conjugates can be used to target a drug toward a tumor. Immunoconjugates are antibodies conjugated Uoined) to a second molecule, usually a toxin, radioisotope or label. Immunoconjugates can provide for relatively high concentrations of drug within the tumor whereas systemic administration of unconjugated (i.e., untargeted) drug to achieve the same tumor concentration can lead to levels that are toxic to normal cells.

Another promising area is development of treatments that harness the immune system to attack and kill tumor cells. Checkpoint inhibitors, such as anti-CTLA4, anti-PD1 and anti-POL1 therapies have changed the way cancer is treated. Similarly, the direct activation of cytotoxic T cells by bispecific T cell engagers or CAR-T engineered T cells, has led to previously unseen cures in many types of cancers.

Delta-like ligand 3 (DLL3) is an inhibitory notch ligand that is expressed at relatively low levels in normal tissues. It is expressed at high levels in small cell lung cancer (SCLC) and other neuroendocrine tumors, thus presenting potential therapeutic target in cancer diagnosis and treatment.

Mucin 17, also referred to as MUC17, is a member of the mucin family that is composed of more than 20 members. Mucins are large, highly glycosylated membrane bound proteins. They generally function in mucosal areas to protect epithelial cells from their environment, as well as to regulate proliferation and survival of cells. MUC17 is expressed in pancreatic, appendiceal, and some colon cancers and thus is a target antigen for these cancers. Thus, MUC17 is a candidate for targeting of therapies such as antibody drug conjugates, T cell engagers, and CAR-T cells.

Claudin-18 (CLDN18) is a protein in humans that is encoded by the CLDN18 gene. It belongs to the group of claudins, a family of proteins that form components of tight cell junction strands in epithelial cells. Studies have demonstrated that Isoform 2 (Claudin 18.2 or CLDN18.2) is abundant in gastric tumors. It has exposed extracellular loops and is available for monoclonal antibody binding. These biological characteristics have led to the development of monoclonal antibodies against claudin 18.2, such as claudiximab (IMAB362).

CD3, CD28 and CD137 are receptors present on T-cells. T cells can be activated though CD3, CD28 and CD137, by antigen-presenting cells that utilize the activation signals MHC Class I and II, CD80 and CD86, and 4-1BBL, respectively. CD3 is part of the T cell receptor (TCR) and is the signaling component for the receptor. There are three CD3 subunits, epsilon, delta and gamma. Epsilon associates with both delta and zeta and together they are responsible for signaling. CD3 signaling is considered signal 1 that is required to activate T cells. The co-receptors, CD28 and CD137, are considered signal 2. Both signal 1 and signal 2 are required for full activation, proliferation and survival of T cells.

The present invention discloses trispecific T Cell Engagers. The trispecific and trispecific molecules can bind to DLL3, MUC17 and/or CLDN18.2 and activate CD (cluster of differentiation) molecules (e.g. CD3, CD28 and CD137). Also provided are methods of treating an ailment such as cancer using antibodies and antibody conjugates, pharmaceutical compositions thereof, and articles of manufacture.

SUMMARY

The inventions described and claimed herein have many attributes and embodiments including, but not limited to, those set forth or described or referenced in this brief summary. The inventions described and claimed herein are not limited to, or by, the features or embodiments identified in this summary, which is included for purposes of illustration only and not restriction.

An aspect of the invention is an antibody against DLL3. The antibody can be a fragment such as an antigen binding fragment (Fab) or a single chain variable fragment (Scfvs).

An aspect of the invention is an agonist antibody that activates CD3, CD28 and/or CD137.

An aspect of the invention is a bispecific or trispecific molecule that includes an antibody (or fragment) against DLL3 paired with an antibody (or fragment) of an agonist antibody that activates CD3, CD28 or CD137.

An aspect of the invention is a method of treating an ailment such as cancer using an antibody (or fragment) against DLL3 paired with an antibody (or fragment) of an agonist antibody that activates CD3, CD28 or CD137.

An aspect of the invention is a method of treating an ailment that uses two or more of the triispecific molecules described herein in combination with one another.

An aspect of the invention is a method of treating an ailment that uses one bispecific and one trispecific molecule described herein in combination with one another.

An aspect of the invention is a method of treating an ailment that uses two or more trispecific molecules described herein in combination with one another.

An aspect on the invention is a method of activating T-cell cytotoxicity against DLL3 expressing cells.

An aspect of the invention is a method of activating T-cell cytotoxicity using a bispecific molecule the includes an antibody (or fragment) against DLL3 paired with an antibody (or fragment) of an agonist antibody that activates CD3, CD28 or CD137.

An aspect of the invention is a humanized antibody which binds to human DLL3 protein comprising a heavy chain variable domain having at least 95%, at least 96%, at least 97%, at least 98%, at least 99%, or at least 100% sequence identity to SEQ ID NO: 56-74 or 75.

The disclosed methods can utilize any DLL3 antibody, including for example, an anti-DLL3 antibody comprising three CDRs of a heavy chain variable region amino acid sequence of SEQ ID NO: 1-27 or 29.

An aspect of the invention is a humanized antibody which binds to human DLL3 protein comprising a light chain variable domain having at least 95%, at least 96%, at least 97%, at least 98%, at least 99%, or at least 100% sequence identity to SEQ ID NO: 76-90 or 91.

The disclosed methods can utilize any DLL3 antibody, including for example, an anti-DLL3 antibody comprising three CDRs of a light chain variable region amino acid sequence of SEQ ID NO: 32-54 or 55.

An aspect of the invention is an antibody against MUC17. The antibody can be a fragment such as an antigen binding fragment (Fab) or a single chain variable fragment (Scfv).

An aspect of the invention is an agonist antibody that activates CD3, CD28 and/or CD137.

An aspect of the invention is a bispecific or trispecific molecule that includes an antibody (or fragment) against MUC17 paired with an antibody (or fragment) of an agonist antibody that activates CD3, CD28 or CD137.

An aspect of the invention is a method of treating an ailment such as cancer using an antibody (or fragment) against MUC17 paired with an antibody (or fragment) of an agonist antibody that activates CD3, CD28 or CD137.

An aspect of the invention is a method of treating an ailment that uses two or more of the bispecific or trispecific molecules described herein in combination with one another.

An aspect on the invention is a method of activating T-cell cytotoxicity against MUC17 expressing cells.

An aspect of the invention is a method of activating T-cell cytotoxicity using a bispecific or trispecific molecule the includes an antibody (or fragment) against MUC17 paired with an antibody (or fragment) of an agonist antibody that activates CD3, CD28 or CD137.

An aspect of the invention is a humanized antibody which binds to human MUC17 protein comprising a heavy chain variable domain having at least 95%, at least 96%, at least 97%, at least 98%, at least 99%, or at least 100% sequence identity to SEQ ID NO: 127-245 or 246.

The disclosed methods can utilize any MUC17 antibody, including for example, an anti-MUC17 antibody comprising three CDRs of a heavy chain variable region amino acid sequence of SEQ ID NO: 92-111 or 112.

The disclosed methods can utilize any MUC17 antibody, including for example, an anti-MUC17 antibody comprising three CDRs of a light chain variable region amino acid sequence of SEQ ID NO: 113-125 or 126.

An aspect of the invention is a humanized antibody which binds to human MUC17 protein comprising a light chain variable domain having at least 95%, at least 96%, at least 97%, at least 98%, at least 99%, or at least 100% sequence identity to SEQ ID NO: 147-168 or 169.

The disclosed methods can utilize any MUC17 antibody, including for example, an anti-MUC17 antibody comprising three CDRs of a heavy chain variable region amino acid sequence of SEQ ID NO: 92-111 or 112.

The disclosed methods can utilize any MUC17 antibody, including for example, an anti-MUC17 antibody comprising three CDRs of a light chain variable region amino acid sequence of SEQ ID NO: 113-125 or 126.

An aspect of the invention is a method of treating an ailment such as cancer using an antibody (or fragment) against CLDN18.2 paired with an antibody (or fragment) of an agonist antibody that activates CD3, CD28 or CD137.

An aspect on the invention is a method of activating T-cell cytotoxicity against CLDN18.2 expressing cells.

An aspect of the invention is a method of activating T-cell cytotoxicity using a bispecific or trispecific molecule the includes an antibody (or fragment) against CLDN18.2 paired with an antibody (or fragment) of an agonist antibody that activates CD3, CD28 or CD137.

An aspect of the invention is a method of activating T-cell cytotoxicity using a trispecific molecule the includes an antibody (or fragment) against CLDN18.2 paired with an antibody (or fragment) of an agonist antibody that activates CD3, CD28 and/or CD137.

The disclosed methods can utilize any CLDN18.2 antibody, including for example, an anti-CLDN18.2 antibody comprising three CDRs of a heavy chain variable region amino acid sequence of SEQ ID NO: 170-186 or 187.

An aspect of the invention is a humanized antibody which binds to human CLDN18.2 protein comprising a heavy chain variable domain having at least 95%, at least 96%, at least 97%, at least 98%, at least 99%, or at least 100% sequence identity to SEQ ID NO: 197-205 or 206.

The disclosed methods can utilize any CLDN18.2 antibody, including for example, an anti-CLDN18.2 antibody comprising three CDRs of a light chain variable region amino acid sequence of SEQ ID NO: 188-195 or 196.

An aspect of the invention is a humanized antibody which binds to human CLDN18.2 protein comprising a light chain variable domain having at least 95%, at least 96%, at least 97%, at least 98%, at least 99%, or at least 100% sequence identity to SEQ ID NO: 207-212 or 213.

The disclosed methods can utilize any CLDN18.2 antibody, including for example, an anti-CLDN18.2 antibody comprising three CDRs of a heavy chain variable region amino acid sequence of SEQ ID NO: 170-186 or 187.

The disclosed methods can utilize any CLDN18.2 antibody, including for example, an anti-CLDN18.2 antibody comprising three CDRs of a light chain variable region amino acid sequence of SEQ ID NO: 188-195 or 196.

Another aspect of the invention is a method of activating T-cell cytotoxicity using a triispecific molecule the includes more than one antibodies (or fragments) against DLL3, MUC17 and/or CLDN18.2 paired with one or more antibodies (or fragments) of an agonist antibodies that activate one or more of CD3, CD28 or CD137.

Another aspect of the invention is a trispecific molecule that includes (a) an anti-DLL3 antibody, an anti-Muc17 antibody or an anti-Cldn18.2 antibody, (b) a first antigen binding entity and (c) a second antigen binding entity. In one embodiment, the first antigen binding entity is comprised of an anti-CD28 scFv domain and the second antigen binding entity is comprised of an anti-CD3 Scfv-Fc domain. The first antigen binding entity and the second antigen binding entity form a heterodimer configuration. In one embodiment, the trispecific molecule includes a first chain of SEQ. ID NO: 347, a second chain of SEQ. ID NO: 276 and a third chain of SEQ. ID NO: 297. In another embodiment, the trispecific molecule includes a first chain of SEQ. ID NO: 430, a second chain of SEQ. ID NO: 276 and a third chain of SEQ. ID NO: 297. Alternatively, the trispecific molecule can include a first chain of SEQ. ID NO: 481, a second chain of SEQ. ID NO: 406 and a third chain of SEQ. ID NO: 413.

In some embodiments, the targeting domains are linked to one another by peptide bonds via peptide linkers or through covalent conjugates using appropriate crosslinking technologies known in the art.

In some embodiments, the targeting domains comprise antibody variable regions. In some embodiments, the targeting domains are in the form of a single domain antibody (sdAb), a fragment variable (Fv) heterodimer, a single chain Fv (scFv), a Fab fragment, a TriFab, or a combination thereof.

In some embodiments, the trispecific molecules are administered with a checkpoint inhibitor.

In some embodiments, the trispecific molecules are administered with an anti-PD1 and/or anti-POL1 antagonists.

Other features and advantages of aspects of the present invention will become apparent from the following more detailed description, taken in conjunction with the accompanying drawings, which illustrate, by way of example, the principles of aspects of the invention.

BRIEF DESCRIPTION OF THE DRAWINGS

The accompanying drawings illustrate aspects of the present invention. In such drawings:

FIG. 1A to 1R depict Scfv-scfv-FcxFab-Fc formats for the trispecific molecules of the invention.

FIG. 1A depicts an anti-CD3, anti-DLL3, anti-CD28 (scfv-scfv-FcxFab-Fc) molecule.

FIG. 1B depicts an anti-CD3, anti-DLL3, anti-CD137 (scfv-scfv-FcxFab-Fc) molecule.

FIG. 1C depicts an anti-CD28, anti-DLL3, anti-CD137 (scfv-scfv-FcxFab-Fc) molecule.

FIG. 1D depicts an anti-CD28, anti-DLL3, anti-CD3 (scfv-scfv-FcxFab-Fc) molecule.

FIG. 1E depicts an anti-CD137, anti-DLL3, anti-CD3 (scfv-scfv-FcxFab-Fc) molecule.

FIG. 1F depicts an anti-CD137, anti-DLL3, anti-CD28 (scfv-scfv-FcxFab-Fc) molecule.

FIG. 1M depicts an anti-CD28, anti-CD3, anti-DLL3 (scfv-scfv-FcxFab-Fc) molecule.

FIG. 1N depicts an anti-CD137, anti-CD3, anti-DLL3 (scfv-scfv-FcxFab-Fc) molecule.

FIG. 1O depicts an anti-CD 137, anti-CD28, anti-DLL3 (scfv-scfv-FcxFab-Fc) molecule.

FIG. 1P depicts an anti-CD3, anti-CD28, anti-DLL3 (scfv-scfv-FcxFab-Fc) molecule.

FIG. 1Q depicts an anti-CD3, anti-CD137, anti-DLL3 (scfv-scfv-FcxFab-Fc) molecule.

FIG. 1R depicts an anti-CD28, anti-CD137, anti-DLL3 (scfv-scfv-FcxFab-Fc)

FIG. 8A depicts a bispecific molecule of anti-CD137, anti-DLL3, anti-DLL3 (scfv-scfv-Fcx Fab-Fc) molecule.

FIG. 8B depicts an anti-CD137, anti-DLL3, anti-CD3 (scfv-scfv-FcxFab-Fc) molecule.

FIG. 8C depicts an anti-CD137, anti-DLL3, anti-CD3 (scfv-scfv-FcxFab-Fc) molecule.

FIG. 9A depicts an anti-DLL3, anti-CD3, anti-CD137, anti-CD137 (scfv-scfv-FcxFe-Scfv) molecule.

FIG. 9B depicts an anti-DLL3, anti-CD3, anti-CD137, anti-CD137 (scfv-scfv-Fcx Scfv-Fc-Scfv) molecule.

FIG. 9C depicts an anti-CD137, anti-CD137, anti-DLL3 (scfv-scfv-FcxFab-Fc) molecule.

FIG. 9D depicts an anti-DLL3, anti-CD137, anti-CD137 (scfv-scfv-FcxFab-Fc) molecule.

FIG. 9E depicts an anti-DLL3, anti-CD3, anti-CD137 (Fab-Fc-ScfvxScfv-Fc-Scfv) molecule.

FIG. 9F depicts an anti-DLL3, anti-CD3, anti-CD137 (Fab-Fc-Scfv-ScfvxScfv-Fc) molecule.

FIG. 10A to 1OR depict Scfv-scfv-FcxFab-Fc formats for the trispecific molecules of the invention.

FIG. 10A depicts an anti-CD3, anti-MUC17, anti-CD28 (scfv-scfv-FcxFab-Fc) molecule.

FIG. 10B depicts an anti-CD3, anti-MUC17, anti-CD137 (scfv-scfv-FcxFab-Fc) molecule.

FIG. 10C depicts an anti-CD28, anti-MUC17, anti-CD137 (scfv-scfv-FcxFab-Fc) molecule.

FIG. 10D depicts an anti-CD28, anti-MUC17, anti-CD3 (scfv-scfv-FcxFab-Fc) molecule.

FIG. 10E depicts an anti-CD137, anti-MUC17, anti-CD3 (scfv-scfv-FcxFab-Fc) molecule.

FIG. 10F depicts an anti-CD137, anti-MUC17, anti-CD28 (scfv-scfv-FcxFab-Fc) molecule.

FIG. 10G depicts an anti-MUC17, anti-CD3, anti-CD28 (scfv-scfv-FcxFab-Fc) molecule.

FIG. 10H depicts an anti-MUC17, anti-CD3, anti-CD137 (scfv-scfv-FcxFab-Fc) molecule.

FIG. 10I depicts an anti-MUC17, anti-CD28, anti-CD137 (scfv-scfv-FcxFab-Fc) molecule.

FIG. 10J depicts an anti-MUC17, anti-CD28, anti-CD3 (scfv-scfv-FcxFab-Fc) molecule.

FIG. 10K depicts an anti-MUC17, anti-CD137, anti-CD3 (scfv-scfv-FcxFab-Fc) molecule.

FIG. 10L depicts an anti-MUC17, anti-CD137, anti-CD28 (scfv-scfv-FcxFab-Fc) molecule.

FIG. 16A-16B are graphs that demonstrate CD28scfvxCD3scfvxMuc17Fab trispecific 328M2 activates PBMCs to express CD25 only when in the presence of Muc17 expressing CHO cells and cannot activate without Muc17 target cells. In contrast the CD3scFvxCD28scFvxMuc17-Fab trispecific 328M1 is able to non-specifically activate cells in the absence of Muc17, similarly to the bispecific lacking Muc17 binding, 328-1.

FIG. 16A shows the expression of CD25(MFI) stimulated by increasing concentrations of the bispecific and trispecific molecules T cells when PBMCs are in the presence of MUCI 7 expressing CHO cells. FIG. 16B shows the expression of CD25(MFI) stimulated by increasing concentrations of the bispecific and trispecific molecules T cells when PBMCs are in the presence of parental CHO cells FIGS. 17A and 17B are graphs that demonstrates CD137xCD3xMuc17 trispecific molecules 34M1 and 34M4 increase CD4 and CD8 T cell numbers when PBMCs are cultured with Muc17 expressing CHO cells to a greater level than the benchmark CD3 bispecific 3M8B7.

FIG. 18A-18D depict Muc17xCD137 and DLL3xCD137 bispecific molecules.

FIG. 19A-19C depict MUC17 bispecifi and trispecific molecules with two CD137 Fab fragments.

FIG. 19A depicts an anti-CD137, anti-MUC17, anti-MUC17 (Fab-Fc-Scfv) molecule.

FIG. 19B depicts an anti-CD137, anti-MUC17, anti-CD3 (Fab-Fc-ScfvxFab-Fc-Scfv) molecule.

FIG. 19C depicts an anti-CD137, anti-MUC17, anti-CD3 (Fab-Fcx Fc-Scfv-Scfv) molecule.

FIG. 19D-19I depict bispecific molecules and trispecific molecules with two anti-CD137 fragments.

FIG. 19D depicts an anti-CD137, anti-CD137, anti-MUC17, (scfv-scfv-FcxFab-Fc) molecule.

FIG. 19E depicts an anti-MUC17, anti-CD137, anti-CD137 (scfv-scfv-FcxFab-Fc) molecule.

FIG. 19F depicts an anti-MUC17, anti-CD137, anti-CD3, anti-CD137 (Fab-Fc-ScfvxScfv-Fc-Scfv) molecule.

FIG. 19G depicts an anti-MUC17, anti-CD137, anti-CD137, anti-CD3 (Fab-Fc-Scfv-ScfvxScfv-Fc) molecule.

FIG. 19H depicts an anti-MUC17, anti-CD3, anti-CD137, anti-CD137 (scfv-scfv-Fc-ScfvxFc-Scfv) molecule.

FIG. 19I depicts an anti-DLL3, anti-CD3, anti-CD137, anti-MUC17, anti-CD137 (scfv-scfv-FcxScfv-Fc-Scfv) molecule.

FIG. 20A depicts an anti-CD3, anti-CLDN18.2, anti-CD28 (scfv-scfv-FcxFab-Fc) molecule.

FIG. 20G depicts an anti-CLDN18.2, anti-CD3, anti-CD28 (scfv-scfv-FcxFab-Fc) molecule.

FIG. 20H depicts an anti-CLDN18.2, anti-CD3, anti-CD137 (scfv-scfv-FcxFab-Fc) molecule.

FIG. 20I depicts an anti-CLDN18.2, anti-CD28, anti-CD137 (scfv-scfv-FcxFab-Fc) molecule.

FIG. 20J depicts an anti-CLDN18.2, anti-CD28, anti-CD3 (scfv-scfv-FcxFab-Fc) molecule.

FIG. 20K depicts an anti-CLDN18.2, anti-CD137, anti-CD3 (scfv-scfv-FcxFab-Fc) molecule.

FIG. 20L depicts an anti-CLDN18.2, anti-CD137, anti-CD28 (scfv-scfv-FcxFab-Fc) molecule.

FIG. 20R depicts an anti-CD28, anti-CD137, anti-CLDN18.2 (scfv-scfv-FcxFab-Fc) molecule.

FIG. 25A-25C depict CLDN18.2 bispecific and trispecific molecules with two CD137 Fab or Scfv fragments.

FIG. 25A depicts an anti-CD137, anti-CLDN18.2, anti-CLDN (scfv-scfv-FcxFab-Fc) molecule.

FIG. 25B depicts an anti-CD137, anti-CLDN18.2, anti-CD3 trispecific molecule (Fab-Fc-ScfvxFab-Fc-Scfv) molecule.

FIG. 25C depicts an anti-CD137, anti-CLDN18.2, anti-CD3 trispecific molecule (Fab-Fc-Scfv-ScfvxFab-Fc)

FIG. 25D depicts an anti-CD137, anti-CD137, anti-CLDN18.2 biispecific molecule (Scfv-Scfv-FcxFab-Fc)

FIG. 25E depicts an anti-CLDN18.2, anti-CD137, anti-CD137, trispecific molecule (Scfv-Scfv-FcxFab-Fc)

FIG. 25F depicts an anti-CLDN18.2, anti-CD137, anti-CD3, anti-CD137 18.2(Fab-Fc-ScfvxScfv-Fc-Scfv) molecule.

FIG. 25G depicts an anti-CLDN18.2, anti-CD3, anti-CD137, anti-CD137 (Fab-Fc-Scfv-ScfvxScfv-Fc) molecule.

FIG. 25H depicts an anti-CLDN18.2, anti-CD3, anti-CD137, anti-CD137 (scfv-scfv-Fc-ScfvxFc-Scfv) molecule.

FIG. 25I depicts an anti-CLDN18.2, anti-CD3, anti-CD137, anti-CD137 (scfv-scfv-FcxScfv-Fc-Scfv) molecule.

DEFINITIONS

Figure 1G:
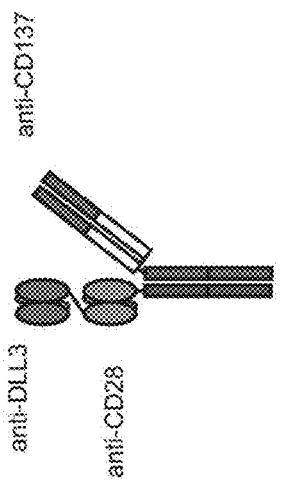
FIG. 1G depicts an anti-DLL3, anti-CD3, anti-CD28 (scfv-scfv-FcxFab-Fc) molecule.
Figure 1J:
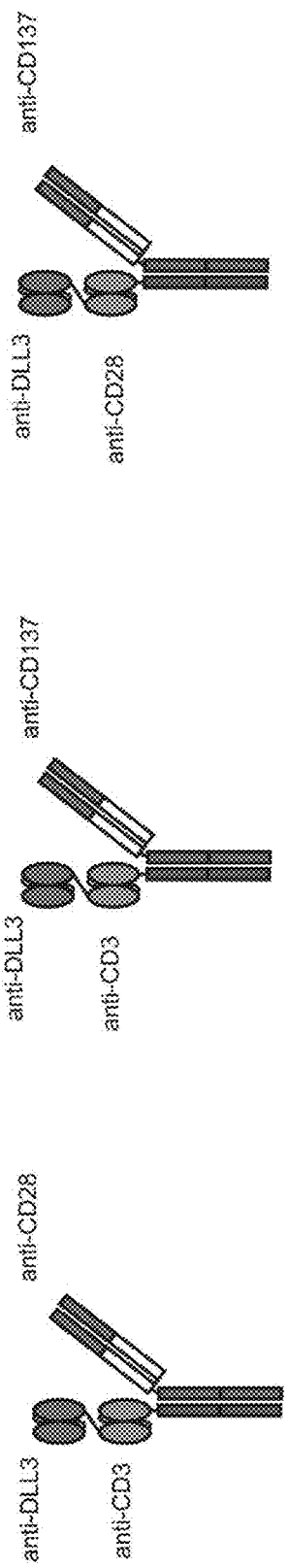
FIG. 1J depicts an anti-DLL3, anti-CD28, anti-CD3 (scfv-scfv-FcxFab-Fc) molecule.
Figure 1H:
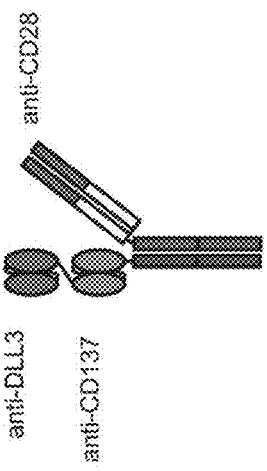
FIG. 1H depicts an anti-DLL3, anti-CD3, anti-CD137 (scfv-scfv-FcxFab-Fc) molecule.
Figure 1K:
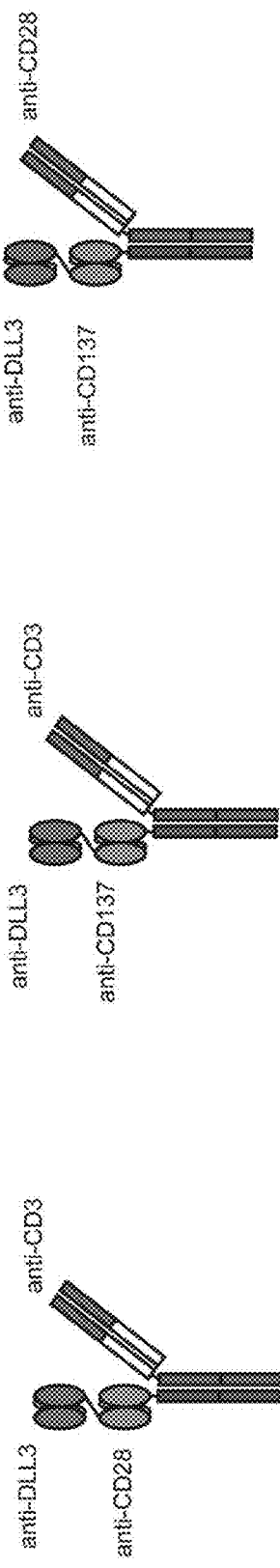
FIG. 1K depicts an anti-DLL3, anti-CD137, anti-CD3 (scfv-scfv-FcxFab-Fc) molecule.
Figure 1I:
FIG. 1I depicts an anti-DLL3, anti-CD28, anti-CD137 (scfv-scfv-FcxFab-Fc) molecule.
Figure 1L:
FIG. 1L depicts an anti-DLL3, anti-CD 137, anti-CD28 (scfv-scfv-FcxFab-Fc) molecule.

Reference in this specification to "one embodiment/aspect" or "an embodiment/aspect" means that a particular feature, structure, or characteristic described in connection with the embodiment/aspect is included in at least one embodiment/aspect of the disclosure. The use of the phrase "in one embodiment/aspect" or "in another embodiment/aspect" in various places in the specification are not necessarily all referring to the same embodiment/aspect, nor are separate or alternative embodiments/aspects mutually exclusive of other embodiments/aspects. Moreover, various features are described which may be exhibited by some embodiments/aspects and not by others. Similarly, various requirements are described which may be requirements for some embodiments/aspects but not other embodiments/aspects. Embodiment and aspect can in certain instances be used interchangeably.

The terms used in this specification generally have their ordinary meanings in the art, within the context of the disclosure, and in the specific context where each term is used. Certain terms that are used to describe the disclosure are discussed below, or elsewhere in the specification, to provide additional guidance to the practitioner regarding the description of the disclosure. It will be appreciated that the same thing can be said in more than one way.

Consequently, alternative language and synonyms may be used for any one or more of the terms discussed herein. Nor is any special significance to be placed upon whether or not a term is elaborated or discussed herein. Synonyms for certain terms are provided. A recital of one or more synonyms does not exclude the use of other synonyms. The use of examples anywhere in this specification including examples of any terms discussed herein is illustrative only, and is not intended to further limit the scope and meaning of the disclosure or of any exemplified term. Likewise, the disclosure is not limited to various embodiments given in this specification.

Without intent to further limit the scope of the disclosure, examples of instruments, apparatus, methods and their related results according to the embodiments of the present disclosure are given below. Note that titles or subtitles may be used in the examples for convenience of a reader, which in no way should limit the scope of the disclosure. Unless otherwise defined, all technical and scientific terms used herein have the same meaning as commonly understood by one of ordinary skill in the art to which this disclosure pertains. In the case of conflict, the present document, including definitions, will control.

As applicable, the terms "about" or "generally", as used herein in the specification and appended claims, and unless otherwise indicated, means a margin of +/−20%. Also, as applicable, the term "substantially" as used herein in the specification and appended claims, unless otherwise indicated, means a margin of +/−10%. It is to be appreciated that not all uses of the above terms are quantifiable such that the referenced ranges can be applied.

The term "subject" or "patient" refers to any single animal, more preferably a mammal (including such non-human animals as, for example, dogs, cats, horses, rabbits, zoo animals, cows, pigs, sheep, and non-human primates) for which treatment is desired. Most preferably, the patient herein is a human. In an embodiment, a "subject" of diagnosis or treatment is a prokaryotic or a eukaryotic cell, a tissue culture, a tissue or an animal, e.g. a mammal, including a human.

As used herein, the term "comprising" is intended to mean that the compositions and methods include the listed elements, but do not exclude other unlisted elements. "Consisting essentially of" when used to define compositions and methods, excludes other elements that alters the basic nature of the composition and/or method, but does not exclude other unlisted elements. Thus, a composition consisting essentially of the elements as defined herein would not exclude trace amounts of elements, such as contaminants from any isolation and purification methods or pharmaceutically acceptable carriers, such as phosphate buffered saline, preservatives, and the like, but would exclude additional unspecified amino acids. "Consisting of" excludes more than trace elements of other ingredients and substantial method steps for administering the compositions described herein. Embodiments defined by each of these transition terms are within the scope of this disclosure and the inventions embodied therein.

The term "tri-specific monoclonal antibody" or "TSMAb" refers to an antibody that can simultaneously engage three different types of epitopes.

The term "active agent" or "active ingredient" refers to a substance, compound, or molecule, which is biologically active or otherwise, induces a biological or physiological effect on a subject to which it is administered to. In other words, "active agent" or "active ingredient" refers to a component or components of a composition to which the whole or part of the effect of the composition is attributed. An active agent can be a primary active agent, or in other words, the component(s) of a composition to which the whole or part of the effect of the composition is attributed. An active agent can be a secondary agent, or in other words, the component(s) of a composition to which an additional part and/or other effect of the composition is attributed.

In an embodiment, a "pharmaceutical composition" is intended to include the combination of an active agent, such as an anti-DLL3, anti-MUC17 or anti-CLDN18.2 antibody and antibody conjugates, with a carrier, inert or active, in a sterile composition suitable for diagnostic or therapeutic use in vitro, in vivo or ex vivo. In one aspect, the pharmaceutical composition is substantially free of endotoxins or is non-toxic to recipients at the dosage or concentration employed.

In an embodiment, "an effective amount" refers, without limitation, to the amount of the defined component sufficient to achieve the desired therapeutic result. In an embodiment, that result can be effective cancer treatment.

In an embodiment, as used herein, the terms "treating," "treatment" and the like are used herein, without limitation, to mean obtaining a desired pharmacologic and/or physiologic effect. The effect may be prophylactic in terms of completely or partially preventing a disorder or sign or symptom thereof, and/or may be therapeutic in terms of amelioration of the symptoms of the disease or infection, or a partial or complete cure for a disorder and/or adverse effect attributable to the disorder.

As used herein, the term "recombinant" refers to polypeptides or polynucleotides that do not exist naturally and which may be created by combining polynucleotides or polypeptides in arrangements that would not normally occur together. The term can refer to a polypeptide produced through a biological host, selected from a mammalian expression system, an insect cell expression system, a yeast expression system, and a bacterial expression system.

The term "Delta-like 3" or "DLL3" refers to a protein which in humans is encoded by the DLL3 gene. Mutations in the gene cause the autosomal recessive genetic disorder Jarcho-Levin syndrome. DLL3 is expressed normally on the inside of cells and at low levels on normal tissues. However, lung tumor cells overexpress the gene and cell surface DLL3 levels are increased.

The term "Mucin 17" or "MUC17" refers to a member of the mucin family that includes more than 20 members. Mucins are large, highly glycosylated membrane bound proteins. They are expressed almost exclusively in the intestine. Their general function is to protect epithelial cells from their environment, as well as to regulate proliferation and survival of cells. MUC17 is highly expressed in pancreatic adenocarcinoma tissue (at protein level). MUC17 is expressed in pancreatic, appendiceal, and some colon cancers. Its expression is not detectable in normal pancreas, in pancreatitis or in cell lines derived from other cancers.

The term "Claudin-18" or "CLD 18" refers to a protein that in humans is encoded by the CLDN18 gene. CLDN18 belongs to the large claudin family of proteins, which form tight junction strands in epithelial cells. "Claudin 18.2" or "CLDN18.2" denotes isoform 2 which is abundant in tumors, particularly those of the gastric system.

The term "CD" or "cluster of differentiation molecules" refers to cell surface markers that are useful for the identification and characterization of leukocytes such as CD3, CD28 and CD137. CD3 is the signaling component of the T cell receptor (TCR) complex. Because CD3 is required for T cell activation, drugs (often monoclonal antibodies) that target it are being investigated as immunostimulants for the treatment of cancer.

CD28 is the major costimulatory molecule required in the generation of T cell-mediated immune responses. Upon interaction with its ligands CD80 and CD86, CD28 transduces activation signals that lead to the expression of anti-apoptotic proteins and enhance the synthesis of several cytokines including IL-2. CD28 costimulatory receptor is present on all T-cells. Agonist antibodies directed against CD28 have led to severe adverse events in the clinic, in contrast to antibodies directed against the other CD28 family members CTLA-4, PD-1, or their B7 ligands, which function as checkpoint inhibitors to overcome tumor immune tolerance and can be used in cancer immunotherapy.

CD137 is a member of the tumor necrosis factor (TNF) receptor family. Its alternative names are tumor necrosis factor receptor superfamily member 9 (TNFRSF9), 4-1BB and induced lymphocyte activation. Agonistic anti-CD137 antibody acts as an activating costimulatory molecule especially important for effector/memory T cells and promotes the survival and proliferation of T lymphocytes. For example, BBK-4, Urelumab and Utomilumab (PF-05082566) targets this receptor to stimulate a more intense immune system attack on cancers.

PD-1 (Programmed cell death protein 1 or CD279) is a protein on the surface of cells that has a role in regulating the immune system's response to the cells of the human body by down-regulating the immune system and promoting self-tolerance by suppressing T cell inflammatory activity. Engagement of PD-1 by either of its ligands, PD-L1 or PD-L2, on an adjacent cell inhibits TCR signaling and TCR-mediated proliferation, transcriptional activation and cytokine production. This prevents autoimmune diseases, but it can also prevent the immune system from killing cancer cells. Therapeutic antibodies designed to block the PD-1/PD-L1 interaction have potential for the treatment of cancer.

Programmed death-ligand 1 (PD-L1) also known as cluster of differentiation 274 (CD274) or B7 homolog 1 (B7-H1) is a protein that in humans is encoded by the CD274 gene. PD-L1 binds to its receptor, PD-1, found on activated T cells, B cells, and myeloid cells, to modulate activation or inhibition.

As used herein, the term "antibody" refers to a polypeptide or a polypeptide complex that specifically recognizes and binds to an antigen through one or more immunoglobulin variable regions. The recognized immunoglobulin genes include the kappa, lambda, alpha, gamma, delta, epsilon, and mu constant region genes, as well as the myriad immunoglobulin variable region genes. Light chains are classified as either kappa or lambda. Heavy chains are classified as gamma, mu, alpha, delta, or epsilon, which in turn define the immunoglobulin classes, IgG, IgM, IgA, IgD and IgE, respectively. Typically, the antigen-binding region of an antibody will be most critical in specificity and affinity of binding and is encoded by the variable domain. An antibody can be a whole antibody, an antigen binding fragment or a single chain thereof.

An exemplary immunoglobulin (antibody) structural unit comprises a tetramer. Each tetramer is composed of two identical pairs of polypeptide chains, each pair having one "light" (about 25 kD) and one "heavy" chain (about 50-70 kD). The N-terminus of each chain defines a variable region of about 100 to 110 or more amino acids primarily responsible for antigen recognition. The terms variable light chain (VL) and variable heavy chain (VH) refer to variable domains of the light and heavy chain respectively.

Antibodies exist, e.g., as intact immunoglobulins or as a number of well-characterized fragments produced by digestion with various peptidases. Thus, for example, pepsin digests an antibody below the disulfide linkages in the hinge region to produce F(ab)'$_2$, a dimer of Fab which itself is a light chain VL-CL joined to VH-CH1 by a disulfide bond. While various antibody fragments are defined in terms of the digestion of an intact antibody, one of skill will appreciate that such fragments may be synthesized de novo either chemically or by using recombinant DNA methodology. Thus, the term antibody, as used herein, also includes antibody fragments either produced by the modification of whole antibodies, or those synthesized de novo using recombinant DNA methodologies (e.g., single chain Fv) or those identified using phage display libraries (see, e.g., McCafferty et al., *Nature* 348:552-554 (1990)).

Accordingly, in either aspect of the invention, the term antibody also embraces minibodies, scFvs, diabodies, triabodies and the like. ScFvs and Diabodies are small bivalent biospecific antibody fragments with high avidity and specificity. Their high signal to noise ratio is typically better due to a better specificity and fast blood clearance increasing their potential for diagnostic and therapeutic targeting of specific antigen (Sundaresan et al., *J Nucl Med* 44:1962-9 (2003). In addition, these antibodies are advantageous because they can be engineered if necessary as different types of antibody fragments ranging from a small single chain Fv (scFv) to an intact IgG with varying isoforms (Wu & Senter, *Nat. Biotechnol.* 23:1137-1146 (2005)). In some embodiments, the antibody fragment is part of a scFv-scFv or diabody. In some embodiments, in either aspect, the invention provides high avidity antibodies for use according to the invention.

The term "agonist antibody" refers to an antibody that stimulates or activates an organ. An antibody can act as an agonist of a receptor, essentially replacing the activity of the normal ligand. The agonist activity can occur when the antibody binds the receptor in a manner that mimics the binding of the physiological ligand resulting in antibody-mediated agonism. For example, agonistic antibodies against the thyrotropin receptor in Grave's disease stimulate the thyroid gland to release thyroid hormones that produce hyperthyroidism. Agonistic antibodies may also stimulate when clustered, either via the Fc portion of the antibody engaging an Fc receptor in trans or cis, or through antigen mediated clustering. The latter clustering mechanism requires antigen engagement by one half of a bispecific or trispecific molecule and engagement of the stimulatory receptor by the second half of a bispecific or trispecific molecule. Exemplary stimulatory receptors are CD3, CD28 and 4-1BB, which stimulate T cells.

The terms "antibody fragment" or "antigen-binding fragment" are used with reference to a portion of an antibody, such as Fab', Fab, Fv, scFv and the like. Regardless of structure, an antibody fragment binds with the same antigen that is recognized by the intact antibody. The term "antibody fragment" also includes diabodies and any synthetic or genetically engineered proteins comprising immunoglobulin variable regions that act like an antibody by binding to a specific antigen to form a complex.

The term "antigen-binding fragment" or "Fab" refers to a region on an antibody that binds to antigens. It includes one constant and one variable domain of each of the heavy and the light chain (i.e. four domains: VH, CH1, VL and CL1). The variable domain contains the paratope (the antigen-binding site), that includes a set of complementary determining regions at the amino terminal end of the monomer. Each arm of the Y thus binds an epitope on the antigen.

The term "Fc region" or "fragment crystallizable region" refers to the tail region of an antibody CH2-CH3 that interacts with cell surface receptors called $F_c$ receptors and some proteins of the complement system. This "effector function" allows antibodies to activate the immune system leading to cellular cytotoxicity (ADCC), antibody-dependent cellular phagocytosis (ADCP), and/or complement dependent cytotoxicity (CDC). ADCC and ADCP are mediated through the binding of the Fc to Fc receptors on the surface of cells of the immune system. CDC is mediated through the binding of the Fc with proteins of the complement system, (e.g. C1q).

In IgG, IgA and IgD antibody isotypes, the Fc region has two identical protein fragments, derived from the second and third constant domains of the antibody's two heavy chains. IgM and IgE Fc regions have three heavy chain constant domains (CH domains 2-4) in each polypeptide chain whereas IgG is composed of 2 CH domains, 2 and 3. The $F_c$ regions of IgGs bear a highly conserved N-glycosylation site. Glycosylation of the $F_c$ fragment is essential for $F_c$ receptor-mediated activity. The N-glycans attached to this site are predominantly core-fucosylated diantennary structures of the complex type. In addition, small amounts of these N-glycans also bear bisecting GlcNAc and a-2,6 linked sialic acid residues.

A particular IgG subclass can be preferred for a particular use. For example, IgG1 is more effective than IgG2 and IgG4 at mediating ADCC and CDC. Thus, IgG2 $F_c$ can be preferred when effector function is undesirable. However, IgG2 Fc-containing molecules are generally more difficult to manufacture and can be less stable than IgG1 Fc-containing molecules. Further, the effector function of an antibody can be increased, or decreased, by introducing one or more mutations into the Fc (see, for example, Strohl, Curr. Opin. Biotech., 20:685-691, 2009). Exemplary IgG1 Fc molecules having increased effector function include those having the following substitutions:

S239D/I 332E, S239D/A330St1332E, S2390/A330L/ 1332E, S298A/0333A/K334A, P2471/A339D, P2471/ A339Q, 0280H/K290S, 0280H/K290S/S298D, 0280H/ K290S/S298V, F243L/R292P/Y300L, F243L/R292P/ Y300L/P396L, F243L/R292P/Y300L/V3051/P396L, G236A/S239D/1332E, K326A/E333A, K326W/ E333S, K290E/S298G/T299A, K290N/S298G/T299A, K290E/S298G/T299A/K326E, K290N/S298G/T299A/ K326E

Fucosylation is another method of increasing effector function of IgG Fc-containing proteins. Removal of the core fucose from the biantennary complex-type oligosachharides attached to the $F_c$ greatly increases ADCC effector function without altering antigen binding or CDC effector function. There are different ways to reduce or abolish fucosylation of Fe-containing molecules. These include recombinant expression in certain mammalian cell lines including a FUT8 knockout cell line, variant CHO line Lec13, rat hybridoma cell line YB2/0, a cell line comprising a small interfering RNA specifically against the FUT8 gene, and a cell line co-expressing β-1,4-N-acetylglucosaminyltransferase III and Golgi a-mannosidase II. Alternatively, the Fc-containing molecule can be expressed in a non-mammalian cell such as a plant cell, yeast, or prokaryotic cell, e.g., *E. coli*.

It may be desirable to decrease effector function. Exemplary $F_c$ molecules having decreased effector function include those having the following substitutions:

N297A or N297Q (IgG1), L234A/L235A (IgG1), V234A/G237A (IgG2), L235A/G237A/E318A (IgG4), H268Q/V309L/A330S/A331S (IgG2), C220S/C226S/C229S/P238S (IgG1), C226S/C229S/E233P/L234V/L235A (IgG1), L234F/L235E/P331S (IgG1), S267E/L328F (IgG1)

Both the light and heavy chains are divided into regions of structural and functional homology. The terms "constant" and "variable" are used functionally. In this regard, it will be appreciated that the variable domains of both the light (VL) and heavy (VH) chain portions determine antigen recognition and specificity. Conversely, the constant domains of the light chain (CL) and the heavy chain (CHI, CH2 and CH3) confer important biological properties such as secretion, transplacental mobility, Fe receptor binding, complement binding, and the like. By convention, the numbering of the constant region domains in conventional antibodies increases as they become more distal from the antigen-binding site or amino-terminus of the antibody. In conventional antibodies, the N-terminal portion is a variable region and at the C-terminal portion is a constant region; the CH3 and CL domains comprise the carboxyterminus of the heavy and light chain, respectively.

As used herein, the term "heavy chain constant region" includes amino acid sequences derived from an immunoglobulin heavy chain. A polypeptide comprising a heavy chain constant region comprises at least one of: a CHI domain, a hinge (e.g., upper, middle, and/or lower hinge region) domain, a CH2 domain, a CH3 domain, or a variant or fragment thereof. For example, an antigen-binding polypeptide for use in the disclosure may comprise a polypeptide chain comprising a CHI domain; a polypeptide chain comprising a CHI domain, at least a portion of a hinge domain, and a CH2 domain; a polypeptide chain comprising a CHI domain and a CH3 domain; a polypeptide chain comprising a CHI domain, at least a portion of a hinge domain, and a CH3 domain, or a polypeptide chain comprising a CHI domain, at least a portion of a hinge domain, a CH2 domain, and a CH3 domain. In some embodiments, a polypeptide of the disclosure comprises a polypeptide chain comprising a CH3 domain. Further, an antibody for use in the disclosure may lack at least a portion of a CH2 domain (e.g., all or part of a CH2 domain). It should be understood that the heavy chain constant region may be modified such that they vary in amino acid sequence from the naturally occurring immunoglobulin molecule.

The heavy chain constant region of an antibody disclosed herein may be derived from different immunoglobulin molecules. For example, a heavy chain constant region of a polypeptide may comprise a CHI domain derived from an IgG1 molecule and a hinge region derived from an IgG3 molecule. In another example, a heavy chain constant region can comprise a hinge region derived, in part, from an IgG1 molecule and, in part, from an IgG3 molecule. In another example, a heavy chain portion can comprise a chimeric hinge derived, in part, from an IgG1 molecule and, in part, from an IgG4 molecule.

As used herein, the term "light chain constant region" includes amino acid sequences derived from antibody light chain. Preferably, the light chain constant region comprises at least one of a constant kappa domain or constant lambda domain. A "light chain heavy chain pair" refers to the collection of a light chain and heavy chain that can form a dimer through a disulfide bond between the CL domain of the light chain and the CHI domain of the heavy chain.

The subunit structures and three-dimensional configurations of the constant regions of the various immunoglobulin classes are well known. As used herein, the term "VH domain" includes the amino terminal variable domain of an immunoglobulin heavy chain and the term "CHI domain" includes the first (most amino terminal) constant region domain of an immunoglobulin heavy chain. The CHI domain is adjacent to the VH domain and is amino terminal to the hinge region of an immunoglobulin heavy chain molecule.

As used herein the term "CH2 domain" includes the portion of a heavy chain molecule that extends, e.g., from about residue 244 to residue 360 of an antibody using conventional numbering schemes (residues 244 to 360, Kabat numbering system; and residues 231-340, EU numbering system). The CH2 domain is unique in that it is not closely paired with another domain. Rather, two N-linked branched carbohydrate chains are interposed between the two CH2 domains of an intact native IgG molecule. The CH3 domain extends from the CH2 domain to the C-terminal of the IgG molecule and comprises approximately 108 residues.

As used herein, the term "hinge region" includes the portion of a heavy chain molecule that joins the CHI domain to the CH2 domain. This hinge region comprises approximately 25 residues and is flexible, thus allowing the two N-terminal antigen-binding regions to move independently. Hinge regions can be subdivided into three distinct domains: upper, middle, and lower hinge domains.

The term "bi-specific monoclonal antibody" or "BSMAb" refers to an antibody that can simultaneously engage two different types of epitopes on the same target or on different targets. An advantage is their ability to redirect specific polyclonal immune cells (e.g. T cells and NK cells) to tumor cells to enhance tumor killing. These antibodies can be divided into two types: IgG like bispecific antibodies which carry an $F_c$ region and therefore retain Fe-mediated effector functions and the non-IgG like formats which rely on their antigen binding capacity to exert their effects. Recombinant techniques have also led to the creation of small fragment molecules. Single chain variable fragments from two different monoclonal antibodies can be combined to form bivalent bispecific antibodies. Examples include bispecific T cell engagers (BiTEs), tandem single chain variable fragments (taFvs), diabodies (Dbs), single chain diabodies (scDbs), and triple bodies. These scFv based antibody fragments have high tumor specificity and tumor penetration due to their small size (ranging from 50 to 60 kDa).

The term "tri-specific monoclonal antibody" or "TSMAb" refers to an antibody that can simultaneously engage three different types of epitopes on the same target or on different targets.

The term "scFv" or "scFv fragment antibody" refers to a small molecular antibody, consisting of VH and VL domains, either in the configuration of VL-VH or VH-VL, with a linker region between them. The scFv fragment antibody can more easily penetrate blood vessel wall and the solid tumor, which makes it a preferred carrier of targeting drugs.

The term "scFvs" or "single-chain variable fragment" refers to divalent (or bivalent) single-chain variable fragments (di-scFvs, bi-scFvs) that can be engineered by linking two scFvs. This can be done by producing a single peptide chain with two VH and two VL regions, yielding tandem scFvs, also known as scFv-scFv molecules. Another possibility is the creation of scFvs with linker peptides that are too short for the two variable regions to fold together (about five amino acids), forcing scFvs to dimerize. This type is known as diabodies.

The term "humanized antibody" refers to an antibody from non-human species whose protein sequences have been modified to increase its similarity to antibody variants produced naturally in humans. The process of "humanization" is usually applied to monoclonal antibodies developed for administration to humans (e.g. antibodies developed as anti-cancer drugs). Humanization can be necessary when the process of developing a specific antibody involves generation in a non-human immune system (such as that in mice).

Bispecific or trispecific antibodies can be generated by chemical cross-linking or by the hybrid hybridoma technology. Alternatively, bispecific or trispecific antibody molecules can be produced by recombinant techniques, for example by linking 2 scFv molecules together with a short linker. For example, VH1-Linker1-VL1-Linker2-VH2-Linker3-VL2. With Linker1 and Linker3 having lengths between 15-30 amino acids and Linker2 being 5-10 amino acids in length. Linkers may be composed of a variety of amino acids, for example repeating units of GGGGS (SEQ ID NO: 504), GKPGS (SEQ ID NO: 505), GEPGS (SEQ ID NO: 506), and/or GGPGS (SEQ ID NO: 507). Dimerization across 2 scFv molecules can be promoted by reducing the length of the linker joining the VH and the VL domain from about 15 amino acids, routinely used to produce scFv fragments, to about 5 amino acids. These linkers favor intrachain assembly of the VH and VL domains, with the configuration VH1-linker1-VL2-Linker2-VH2-Linker 3VL1 and linkers 1 and 3 being 5 amino acids in length. Any suitable short linker can be used. Thus, two fragments assemble into a dimeric molecule. Further reduction of the linker length to 0-2 amino acids can generate trimeric (triabodies) or tetrameric (tetrabodies) molecules.

A "chimeric antibody" is an antibody molecule in which (a) the constant region, or a portion thereof, is altered, replaced or exchanged so that the antigen binding site (variable region) is linked to a constant region of a different or altered class, effector function and/or species, or an entirely different molecule which confers new properties to the chimeric antibody, e.g., an enzyme, toxin, hormone, growth factor, drug, etc.; or (b) the variable region, or a portion thereof, is altered, replaced or exchanged with a variable region having a different or altered antigen specificity.

One of the challenges for efficiently producing bispecific antibody preparations concerns reducing the formation of homodimeric molecules in favor of heterodimeric molecules, when co-expressing chains of different binding specificities. A "heterodimeric antibody" can utilize the "knobs-into-holes" or "charge-pair" formats to preferentially promote correct association of the 2 molecules to form a heterodimer with 2 specificities. These formats are specific to the heavy chain $F_c$ part of the constant region in antibodies. For the knob-into-holes format, the "knobs" part is engineered by replacing a small amino acid with a larger one. It fits into the "hole," which is engineered by replacing a large amino acid with a smaller one. Introduction of T366W mutations in the first $F_c$ creates the "knob" and introduction of T366S, L368A, and Y407V mutations in the second $F_c$ creates the "hole" (numbering of the residues according to the Kabat EU numbering system). For the charge pair format, heterodimerization is favored through stabilizing ionic interactions by introducing interfacing charge residues in the opposing $F_c$ domains. For example, D356K, E357K, and D399K in a first $F_c$ domain, and the mutations K370E, K409D, and K439E into a second $F_c$ domain, or combination thereof. For example, K392D and K409D mutations in a first $F_c$ chain, and D399K and D356K mutations in a second $F_c$ chain, K409E in the first $F_c$ and D399K in the $F_c$, K409E in the first $F_c$ and D399R in the second $F_c$, K409D in the first $F_c$ and D0399K in the second $F_c$, K409D in the first $F_c$ and D399R in the second $F_c$, K392E in the first Fe and D399R in the second Fe, K392E in the first Fe and 0399K in the second Fe, K392D in the first $F_c$ and D399R in the second $F_c$, K392D in the first $F_c$ and 0399K in the second $F_c$, K409D and K360D in the first $F_c$ and D399K and D356K in the second $F_c$, K409D and K370D in the first $F_c$ and D399K and E357K in the second $F_c$, K409D and K392D in the first $F_c$ and D399K, D356K, and E357K in the second $F_c$, K409D and K392D in the first $F_c$ and D399K in the second $F_c$, K409D and K392D in the first $F_c$ and D399K and D356K in the second $F_c$, K409D and K392D in the first $F_c$ and D399K and E357K in the second $F_c$, K409D and K370D in the first $F_c$ and D399K and D357K in the second $F_c$, D399K in the first $F_c$ and K409D and K360D in the second $F_c$, and/or K409D and K439D in the first $F_c$ and D399K and D356K in the second $F_c$, numbered according to the Kabat EU numbering system. Additionally, cysteines may be introduced tSo stabilize the pairing of heterodimers, for example S234C in the first $F_c$ and Y349C in the second $F_c$ or Y349C in the first $F_c$ and S344C in the second $F_c$.

The phrase "specifically (or selectively) binds" to an antibody or "specifically (or selectively) immunoreactive with," when referring to a protein or peptide, refers to a binding reaction that is determinative of the presence of the protein, often in a heterogeneous population of proteins and other biologics. Thus, under designated immunoassay conditions, the specified antibodies bind to a particular protein at least two times the background and more typically more than 10 to 100 times background. Specific binding to an antibody under such conditions requires an antibody that is selected for its specificity for a particular protein. For example, polyclonal antibodies can be selected to obtain only those polyclonal antibodies that are specifically immunoreactive with the selected antigen and not with other proteins. This selection may be achieved by subtracting out antibodies that cross-react with other molecules. A variety of immunoassay formats may be used to select antibodies specifically immunoreactive with a particular protein. For example, solid-phase ELISA immunoassays are routinely used to select antibodies specifically immunoreactive with a protein (see, e.g., Harlow & Lane, *Using Antibodies, A Laboratory Manual* (1998) for a description of immunoassay formats and conditions that can be used to determine specific immunoreactivity).

An "immune response" refers to the action of a cell of the immune system (for example, T lymphocytes, B lymphocytes, natural killer (NK) cells, macrophages, eosinophils, mast cells, dendritic cells and neutrophils) and soluble macromolecules produced by any of these cells or the liver (including Abs, cytokines, and complement) that results in selective targeting, binding to, damage to, destruction of, and/or elimination from a vertebrate's body of invading pathogens, cells or tissues infected with pathogens, cancerous or other abnormal cells, or, in cases of autoimmunity, neurodegeneration or pathological inflammation, normal human cells or tissues.

An "immunoregulator" refers to a substance, an agent, a signaling pathway or a component thereof that regulates an immune response. "Regulating," "modifying" or "modulating" an immune response refers to any alteration in a cell of the immune system or in the activity of such cell. Such regulation includes stimulation or suppression of the immune system which may be manifested by an increase or decrease in the number of various cell types, an increase or decrease in the activity of these cells, or any other changes which can occur within the immune system. Both inhibitory and stimulatory immunoregulators have been identified, some of which may have enhanced function in the cancer, infectious disease or neurodegenerative microenvironment.

A cytotoxic T cell (also known as TC, cytotoxic T lymphocyte, CTL, T-killer cell, cytolytic T cell, CD8+ T-cell or killer T cell) is a T lymphocyte (a type of white blood cell) that kills cancer cells, cells that are infected (particularly with viruses), or cells that are damaged in other ways.

The term "immunotherapy" refers to the treatment of a subject afflicted with, or at risk of contracting or suffering a recurrence of, a disease by a method comprising inducing, enhancing, suppressing or otherwise modifying an immune response. "Treatment" or "therapy" of a subject refers to any type of intervention or process performed on, or the administration of an active agent to, the subject with the objective of reversing, alleviating, ameliorating, inhibiting, slowing down or preventing the onset, progression, development, severity or recurrence of a symptom, complication, condition or biochemical indicia associated with a disease.

"Potentiating an endogenous immune response" means increasing the effectiveness or potency of an existing immune response in a subject. This increase in effectiveness and potency may be achieved, for example, by overcoming mechanisms that suppress the endogenous host immune response or by stimulating mechanisms that enhance the endogenous host immune response.

Nucleic acid is "operably linked" when it is placed into a functional relationship with another nucleic acid sequence. For example, DNA for a pre-sequence or secretory leader is operably linked to DNA for a polypeptide if it is expressed as a pre-protein that participates in the secretion of the polypeptide; a promoter or enhancer is operably linked to a coding sequence if it affects the transcription of the sequence; or a ribosome binding site is operably linked to a coding sequence if it is positioned so as to facilitate translation. Generally, "operably linked" means that the DNA sequences being linked are near each other, and, in the case of a secretory leader, contiguous and in reading phase. However, enhancers do not have to be contiguous. Linking is accomplished by ligation at convenient restriction sites. If such sites do not exist, the synthetic oligonucleotide adaptors or linkers are used in accordance with conventional practice.

"Conservatively modified variants" applies to both amino acid and nucleic acid sequences. With respect to particular nucleic acid sequences, conservatively modified variants refers to those nucleic acids which encode identical or essentially identical amino acid sequences, or where the nucleic acid does not encode an amino acid sequence, to essentially identical sequences. Because of the degeneracy of the genetic code, a large number of functionally identical nucleic acids encode any given protein. For instance, the codons GCA, GCC, GCG and GCU all encode the amino acid alanine. Thus, at every position where an alanine is specified by a codon, the codon can be altered to any of the corresponding codons described without altering the encoded polypeptide. Such nucleic acid variations are "silent variations," which are one species of conservatively modified variations. Every nucleic acid sequence herein which encodes a polypeptide also describes every possible silent variation of the nucleic acid. One of skill will recognize that each codon in a nucleic acid (except AUG, which is ordinarily the only codon for methionine, and TGG, which is ordinarily the only codon for tryptophan) can be modified to yield a functionally identical molecule. Accordingly, each silent variation of a nucleic acid which encodes a polypeptide is implicit in each described sequence with respect to the expression product, but not with respect to actual probe sequences.

The terms "identical" or percent "identity," in the context of two or more nucleic acids or polypeptide sequences, refer to two or more sequences or subsequences that are the same or have a specified percentage of amino acid residues or nucleotides that are the same (i.e., about 60% identity, preferably 65%, 70%, 75%, 80%, 85%, 90%, 91%, 92%, 93%, 94%, 95%, 96%, 97%, 98%, 99%, or higher identity over a specified region, when compared and aligned for maximum correspondence over a comparison window or designated region) as measured using a BLAST or BLAST 2.0 sequence comparison algorithms with default parameters described below, or by manual alignment and visual inspection. Such sequences are then said to be "substantially identical." This definition also refers to, or may be applied to, the compliment of a test sequence. The definition also includes sequences that have deletions and/or additions, as well as those that have substitutions. As described below, the preferred algorithms can account for gaps and the like. Preferably, identity exists over a region that is at least about 25 amino acids or nucleotides in length, or more preferably over a region that is 50-100 amino acids or nucleotides in length.

For sequence comparison, typically one sequence acts as a reference sequence, to which test sequences are compared. When using a sequence comparison algorithm, test and reference sequences are entered into a computer, subsequence coordinates are designated, if necessary, and sequence algorithm program parameters are designated. Preferably, default program parameters can be used, or alternative parameters can be designated. The sequence comparison algorithm then calculates the percent sequence identities for the test sequences relative to the reference sequence, based on the program parameters.

A "comparison window," as used herein, includes reference to a segment of any one of the number of contiguous positions selected from the group consisting of from 20 to the full length of the reference sequence, usually about 25 to 100, or 50 to about 150, more usually about 100 to about 150 in which a sequence may be compared to a reference sequence of the same number of contiguous positions after the two sequences are optimally aligned. Methods of alignment of sequences for comparison are well-known in the art. Optimal alignment of sequences for comparison can be conducted, e.g., by the local homology algorithm of Smith & Waterman, *Adv. Appl. Math.* 2:482 (1981), by the homology alignment algorithm of Needleman & Wunsch, *J. Mol.*

Biol. 48:443 (1970), by the search for similarity method of Pearson & Lipman, *Proc. Nat'l. Acad. Sci. USA* 85:2444 (1988), by computerized implementations of these algorithms (GAP, BESTFIT, FASTA, and TFASTA in the Wisconsin Genetics Software Package, Genetics Computer Group, 575 Science Dr., Madison, Wis.), or by manual alignment and visual inspection (see, e.g., *Current Protocols in Molecular Biology* (Ausubel et al., eds. 1995 supplement)).

A preferred example of algorithm that is suitable for determining percent sequence identity and sequence similarity are the BLAST and BLAST 2.0 algorithms, which are described in Altschul et al., *Nuc. Acids Res.* 25:3389-3402 (1977) and Altschul et al., *J. Mol. Biol.* 215:403-410 (1990), respectively. BLAST and BLAST 2.0 are used, with the parameters described herein, to determine percent sequence identity for the nucleic acids and proteins of the invention. Software for performing BLAST analyses is publicly available through the National Center for Biotechnology Information. This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul et al., supra). These initial neighborhood word hits act as seeds for initiating searches to find longer HSPs containing them. The word hits are extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (N) of 11, an expectation (E) of 10, M=5, N=−4 and a comparison of both strands. For amino acid sequences, the BLASTP program uses as defaults a wordlength of 3, and expectation (E) of 10, and the BLOSUM62 scoring matrix (see Henikoff & Henikoff, *Proc. Natl. Acad. Sci. USA* 89:10915 (1989)) alignments (B) of 50, expectation (E) of 10, M=5, N=−4, and a comparison of both strands.

"Nucleic acid" refers to deoxyribonucleotides or ribonucleotides and polymers thereof in either single- or double-stranded form, and complements thereof. The term encompasses nucleic acids containing known nucleotide analogs or modified backbone residues or linkages, which are synthetic, naturally occurring, and non-naturally occurring, which have similar binding properties as the reference nucleic acid, and which are metabolized in a manner similar to the reference nucleotides. Examples of such analogs include, without limitation, phosphorothioates, phosphoramidates, methyl phosphonates, chiral-methyl phosphonates, 2-O-methyl ribonucleotides, peptide-nucleic acids (PNAs).

Unless otherwise indicated, a particular nucleic acid sequence also implicitly encompasses conservatively modified variants thereof (e.g., degenerate codon substitutions) and complementary sequences, as well as the sequence explicitly indicated. Specifically, degenerate codon substitutions may be achieved by generating sequences in which the third position of one or more selected (or all) codons is substituted with mixed-base and/or deoxyinosine residues (Batzer et al., *Nucleic Acid Res.* 19:5081 (1991); Ohtsuka et al., *J. Biol. Chem.* 260:2605-2608 (1985); Rossolini et al., *Mol. Cell. Probes* 8:91-98 (1994)). The term nucleic acid is used interchangeably with gene, cDNA, mRNA, oligonucleotide, and polynucleotide.

A particular nucleic acid sequence also implicitly encompasses "splice variants." Similarly, a particular protein encoded by a nucleic acid implicitly encompasses any protein encoded by a splice variant of that nucleic acid. "Splice variants," as the name suggests, are products of alternative splicing of a gene. After transcription, an initial nucleic acid transcript may be spliced such that different (alternate) nucleic acid splice products encode different polypeptides. Mechanisms for the production of splice variants vary, but include alternate splicing of exons. Alternate polypeptides derived from the same nucleic acid by read-through transcription are also encompassed by this definition. Any products of a splicing reaction, including recombinant forms of the splice products, are included in this definition. An example of potassium channel splice variants is discussed in Leicher et al., *J. Biol. Chem.* 273(52):35095-35101 (1998).

The term "heterologous" when used with reference to portions of a nucleic acid indicates that the nucleic acid comprises two or more subsequences that are not found in the same relationship to each other in nature. For instance, the nucleic acid is typically recombinantly produced, having two or more sequences from unrelated genes arranged to make a new functional nucleic acid, e.g., a promoter from one source and a coding region from another source. Similarly, a heterologous protein indicates that the protein comprises two or more subsequences that are not found in the same relationship to each other in nature (e.g., a fusion protein).

As used herein, the term "prevention" means all of the actions by which the occurrence of the disease is restrained or retarded.

As used herein, the term "treatment" means all of the actions by which the symptoms of the disease have been alleviated, improved or ameliorated. In the present specification, "treatment" means that the symptoms of cancer, neurodegeneration, or infectious disease are alleviated, improved or ameliorated by administration of the antibodies disclosed herein.

The term "administration" refers to the introduction of an amount of a predetermined substance into a patient by a certain suitable method. The composition disclosed herein may be administered via any of the common routes, as long as it is able to reach a desired tissue, for example, but is not limited to, intraperitoneal, intravenous, intramuscular, subcutaneous, intradermal, oral, topical, intranasal, intrapulmonary, or intrarectal administration. However, since peptides are digested upon oral administration, active ingredients of a composition for oral administration should be coated or formulated for protection against degradation in the stomach.

The term "subject" refers to those suspected of having or diagnosed with cancer, a neurodegenerative or an infectious disease. However, any subject to be treated with the pharmaceutical composition disclosed herein is included without limitation. The pharmaceutical composition including an anti-DLL3 antibody disclosed herein is administered to a subject suspected of having cancer, a neurodegenerative or an infectious disease.

Construction of suitable vectors containing the desired sequences and control sequences employs standard ligation and restriction techniques, which are well understood in the art (see Maniatis et al., in *Molecular Cloning: A Laboratory Manual*, Cold Spring Harbor Laboratory, New York (1982)). Isolated plasmids, DNA sequences, or synthesized oligonucleotides are cleaved, tailored, and re-ligated in the form desired.

For preparation of antibodies, e.g., recombinant, monoclonal, or polyclonal antibodies, many techniques known in the art can be used (see, e.g., Kohler & Milstein, *Nature* 256:495-497 (1975); Kozbor et al., *Immunology Today* 4:72 (1983); Cole et al., in *Monoclonal Antibodies and Cancer Therapy*, Alan R. Liss, Inc., pp. 77-96 (1985); Coligan, *Current Protocols in Immunology* (1991); Harlow & Lane, *Antibodies, A Laboratory Manual* (1988); and Goding, *Monoclonal Antibodies: Principles and Practice* (2d ed. 1986)). The genes encoding the heavy and light chains of an antibody of interest can be cloned from a cell, e.g., the genes encoding a monoclonal antibody can be cloned from a hybridoma and used to produce a recombinant monoclonal antibody. Gene libraries encoding heavy and light chains of monoclonal antibodies can also be made from hybridoma or plasma cells. Random combinations of the heavy and light chain gene products generate a large pool of antibodies with different antigenic specificity (see, e.g., Kuby, *Immunology* (3rd ed. 1997)). Techniques for the production of single chain antibodies or recombinant antibodies (U.S. Pat. Nos. 4,946,778, 4,816,567) can be adapted to produce antibodies to polypeptides of this invention. Also, transgenic mice, or other organisms such as other mammals, may be used to express humanized or human antibodies (see, e.g., U.S. Pat. Nos. 5,545,807; 5,545,806; 5,569,825; 5,625,126; 5,633,425; 5,661,016, Marks et al., *Bio/Technology* 10:779-783 (1992); Lonberg et al., *Nature* 368:856-859 (1994); Morrison, *Nature* 368:812-13 (1994); Fishwild et al., *Nature Biotechnology* 14:845-51 (1996); Neuberger, *Nature Biotechnology* 14:826 (1996); and Lonberg & Huszar, *Intern. Rev. Immunol.* 13:65-93 (1995)). Alternatively, phage display technology can be used to identify antibodies and heteromeric Fab fragments that specifically bind to selected antigens (see, e.g., McCafferty et al., *Nature* 348:552-554 (1990); Marks et al., *Biotechnology* 10:779-783 (1992)). Antibodies can also be made bispecific, i.e., able to recognize two different antigens (see, e.g., WO 93/08829, Traunecker et al., *EMBO J.* 10:3655-3659 (1991); and Suresh et al., *Methods in Enzymology* 121:210 (1986)). Antibodies can also be heteroconjugates, e.g., two covalently joined antibodies, or immunotoxins (see, e.g., U.S. Pat. No. 4,676,980, WO 91/00360; and WO 92/200373).

Methods for humanizing antibodies are well known in the art. Generally, a humanized antibody has one or more amino acid residues introduced into it from a source which is non-human. These non-human amino acid residues are often referred to as import residues, which are typically taken from an import variable domain. Humanization can be essentially performed following the method of Winter and co-workers (see, e.g., Jones et al., *Nature* 321:522-525 (1986); Riechmann et al., *Nature* 332:323-327 (1988); Verhoeyen et al., *Science* 239:1534-1536 (1988) and Presta, *Curr. Op. Struct. Biol.* 2:593-596 (1992)), by substituting rodent CDRs or CDR sequences for the corresponding sequences of a human antibody. Accordingly, such humanized antibodies are chimeric antibodies (U.S. Pat. No. 4,816,567), wherein substantially less than an intact human variable domain has been substituted by the corresponding sequence from a non-human species. In practice, humanized antibodies are typically human antibodies in which some CDR residues and possibly some FR residues are substituted by residues from analogous sites in rodent antibodies.

The term "cancer" refers to human cancers and carcinomas, sarcomas, adenocarcinomas, etc., including solid tumors, kidney, breast, lung, kidney, bladder, urinary tract, urethra, penis, vulva, vagina, cervical, colon, ovarian, prostate, pancreas, stomach, brain, head and neck, skin, uterine, testicular, esophagus, and liver cancer. Additional cancers include, for example, Hodgkin's Disease, multiple myeloma, neuroblastoma, breast cancer, ovarian cancer, lung cancer, rhabdomyosarcoma, primary thrombocytosis, primary macroglobulinemia, small-cell lung tumors, primary brain tumors, stomach cancer, colon cancer, malignant pancreatic insulanoma, malignant carcinoid, premalignant skin lesions, testicular cancer, thyroid cancer, neuroblastoma, esophageal cancer, genitourinary tract cancer, malignant hypercalcemia, cervical cancer, endometrial cancer, and adrenal cortical cancer.

The term "checkpoint inhibitor" or "immune checkpoint inhibitor" refers to an agent such as a drug that inhibits/blocks the inhibitory checkpoint molecules. Some cancers can protect themselves from attack by stimulating immune checkpoint targets. Checkpoint therapy can block inhibitory checkpoints, restoring immune system function.

The term "immune checkpoint regulator" refers to receptors and their associated ligands, which together provide a means for inhibiting or stimulating signaling pathways that otherwise lead to T-cell activation. Immune checkpoint regulators include TIGIT and its CD155 ligand, PVR; PD-1 and its ligands, PD-L1 and PD-L2; CTLA-4 and its ligands, B7-1 and B7-2; TIM-3 and its ligand, Galectin-9; LAG-3 and its ligands, including liver sinusoidal endothelial cell lectin (LSECtin) and Galectin-3; CD122 and its CD122R ligands; CD70, B7H3, B and T lymphocyte attenuator (BTLA), and VISTA.

The term "checkpoint regulator antagonist," "immune checkpoint binding antagonist" and "immune checkpoint antagonist" refer to a class of agents that interfere with (or inhibit) the activity of an immune checkpoint regulator so that, as a result of the binding to the checkpoint regulator or its ligand, signaling through the checkpoint regulator receptor is blocked or inhibited. By inhibiting this signaling, immune-suppression can be reversed so that T cell immunity against cancer cells can be re-established or enhanced. Immune checkpoint regulator antagonists include antibody fragments, peptide inhibitors, dominant negative peptides and small molecule drugs, either in isolated forms or as part of a fusion protein or conjugate. Example targets of checkpoint regulator antagonists include PD1, POL1, CTLA4, LAG3, TIM-3, TIGIT, VISTA.

The term "immune checkpoint binding agonist" and "immune checkpoint agonist" refer to a class of agents that stimulate the activity of an immune checkpoint regulator so that, as a result of the binding to the checkpoint regulator or its ligand, signaling through the checkpoint regulator receptor is stimulated. By stimulating this signaling, T cell immunity against cancer cells can be re-established or enhanced. The targets of checkpoint regulator agonists include members of the tumor necrosis factor (TNF) receptor superfamily, such as CD27, CD40, OX40 (CD 134), glucocorticoid-induced TNFR family-related protein (GITR), and 4-1BB (CD137) and their ligands. Additional targets of checkpoint regulator agonists belong to the B7-CD28 superfamily, including CD28 and ICOS.

In any of the embodiments above, one or more cancer therapies, e.g., chemotherapy, radiation therapy, immunotherapy, surgery, or hormone therapy can be co-administered further with an antibody of the invention.

In one embodiment, the chemotherapeutic reagent is an alkylating agent: nitrogen mustards, nitrosoureas, tetrazines, aziridines, cisplatins and derivatives, and non-classical alkylating agents. Nitrogen mustards include mechlorethamine, cyclophosphamide, melphalan, chlorambucil, ifosfamide and busulfan. Nitrosoureas include N-Nitroso-N-methylurea (MNU), carmustine (BCNU), lomustine (CCNU) and semustine (MeCCNU), fotemustine and streptozotocin. Tetrazines include dacarbazine, mitozolomide and temozolomide. Aziridines include thiotepa, mytomycin and diaziquone (AZQ). Cisplatin and derivatives include cisplatin, carboplatin and oxaliplatin. In one embodiment the chemotherapeutic reagent is an anti-metabolites: the anti-folates (e.g., methotrexate), fluoropyrimidines (e.g., fluorouracil and capecitabine), deoxynucleoside analogues and thiopurines. In another embodiment the chemoptheraputic reagent is an anti-microtubule agent such as *vinca* alkaloids (e.g., vincristine and vinblastine) and taxanes (e.g., paclitaxel and docetaxel). In another embodiment the chemotherapeutic reagent is a topoisomerase inhibitor or a cytotoxic antibiotic such as doxorubicin, mitoxantrone, bleomycin, actinomycin, and mitomycin.

The contacting of the patient with the antibody or antibody fragment, can be by administering the antibody to the patient intravenously, intraperitoneally, intramuscularly, intratumorally, or intradermally. In some embodiments the antibody is co-administered with a cancer therapy agent.

The term "formulation" as used herein refers to the antibodies disclosed herein and excipients combined together which can be administered and has the ability to bind to the corresponding receptors and initiate a signal transduction pathway resulting in the desired activity. The formulation can optionally comprise other agents.

All numerical designations, e.g., pH, temperature, time, concentration, and molecular weight, including ranges, are to be understood as approximations in accordance with common practice in the art. When used herein, the term "about" may connote variation (+) or (−) 1%, 5% or 10% of the stated amount, as appropriate given the context. It is to be understood, although not always explicitly stated, that the reagents described herein are merely exemplary and that equivalents of such are known in the art.

Many known and useful compounds and the like can be found in Remington's Pharmaceutical Sciences (13$^{th}$ Ed), Mack Publishing Company, Easton, PA-a standard reference for various types of administration. As used herein, the term "formulation(s)" means a combination of at least one active ingredient with one or more other ingredient, also commonly referred to as excipients, which may be independently active or inactive. The term "formulation" may or may not refer to a pharmaceutically acceptable composition for administration to humans or animals and may include compositions that are useful intermediates for storage or research purposes.

As the patients and subjects of the invention method are, in addition to humans, veterinary subjects, formulations suitable for these subjects are also appropriate. Such subjects include livestock and pets as well as sports animals such as horses, greyhounds, and the like.

DETAILED DESCRIPTION

The DLL3 gene provides instructions for making a protein that helps control the Notch pathway, an important pathway in embryonic development. DLL3 is usually an intracellular protein but it is also expressed on the surface of cancer cells. DLL3 is expressed normally on the inside of cells and at low levels on normal tissues. However, lung tumor cells overexpress the gene and cell surface DLL3 levels are increased. Recent studies have reported that DLL3 is also expressed in other tumor types of neuroendocrine origin, including melanoma, glioblastoma multiforme, small cell bladder cancer, metastatic castration-resistant prostate cancer, and neuroendocrine lung tumors.

CD (cluster of differentiation) molecules (e.g. CD3, CD28 and CD137) CD3, CD28 and CD137 are receptors present on T cells. T cells can be activated by antigen-presenting cells via CD3, CD28 and CD137. Two parallel therapeutic strategies are pursued for activating or engaging T cells to kill tumor cells.

Embodiments of the invention include methods of diagnosing, prognosing, treating, monitoring and preventing cancer, including refractory cancer, using anti-DLL3 antibodies and antibody conjugates, pharmaceutical compositions thereof, and articles of manufacture. More specifically, the invention is directed to bispecific or trispecific molecules that bind to DLL3 and activate CD (cluster of differentiation) molecules (e.g. CD3, CD28 and CD137).

Embodiments of the invention also include methods of diagnosing, prognosing, treating, monitoring and preventing cancer, including refractory cancer, using anti-MUC17 antibodies and antibody conjugates, pharmaceutical compositions thereof, and articles of manufacture. More specifically, the invention is directed to bispecific or trispecific molecules that bind to MUC17 and activate CD (cluster of differentiation) molecules (e.g. CD3, CD28 and CD137).

Embodiments of the invention also include methods of diagnosing, prognosing, treating, monitoring and preventing cancer, including refractory cancer, using anti-CLDN18.2 antibodies and antibody conjugates, pharmaceutical compositions thereof, and articles of manufacture. More specifically, the invention is directed to trispecific molecules that bind to CLDN18.2 and activate CD (cluster of differentiation) molecules (e.g. CD3, CD28 and CD137).

DLL3 T-Cell Engagers

Embodiments of the invention include bispecific and trispecific monoclonal antibodies (BSMAbs and TSMAbs, respectively). The single chain variable fragment (scFv) of a first antibody can be joined with the antigen binding fragment (Fab) of a second antibody. For example, the scFv portion of an antibody against CD3 can be linked to a Fab portion of an antibody against DLL3. They can be joined with 4×GKPGS (SEQ ID NO: 508) or 4×G4S (SEQ ID NO: 509) linkers. The IgG1 Fc can be heterodimerized with charge pair or "knob into hole" mutations or charge pair mutations. The Fc effector function can be minimized through the introduction of N297A/G mutations or LLP mutations. The combination can bring an effector cell (T-cell or NK cell) into the proximity of the tumor cell to enhance antitumor effect.

FIGS. 1A-1R, 8A-8C and 9A-9F depict several formats for trispecific molecules of the invention. The DLL3×CD3 trispecific molecules can activate T cell cytotoxicity against DLL3 expressing CHO cells or NCI-H82 tumor cells. This is exemplified by the release of LDH upon cell death, as well as the upregulation of CD25 on the T cells. When combined with DLL3×CD28 or DLL3×CD137 trispecific molecules, the T cells are further activated, proliferate, and release IFN gamma and IL-2.

CD28 signaling is essential for the activity of anti-PD1 and anti-PDL1 antibodies, thus co-dosing the DLL3×CD28 trispecific molecules with anti-PD1 and anti-PDL1 can improve the responses to the inhibition of the PD1/PDL1 pathway. CD137 is highly expressed on exhausted T cells, which cannot be stimulated by PD1/PDL1 stimulation alone. However, DLL3×CD137 or DLL3×CD28×CD137 stimulation combined with PD-1 blockade results in robust antitumor immunity.

FIG. 1A-1R depict trispecific molecules with combinations of an anti-DLL3 with anti-CD3, anti-CD28 and anti-CD137 in the Scfv-Scfv-Fc×Fab-Fc configuration. FIG. 1A-1F depict trispecific with the configuration scfv-DLL3scfv-Fc×Fab-Fc. FIG. 1G-1L depict trispecific molecules with the configuration DLL3scfv-scfv-Fc×Fab-Fc. FIG. 1M-1R depict depict trispecific molecules with the configuration scfv-scfv-Fc×DLL3Fab-Fc.

Figure 8A:
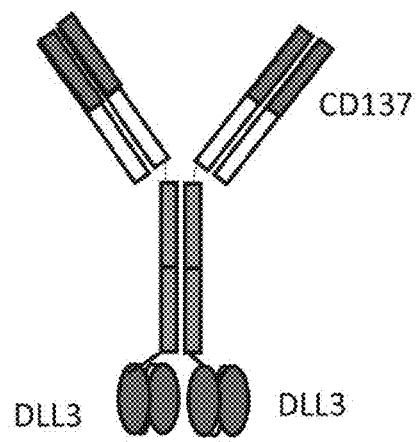
FIG. 8A-8C depict bispecific and trispecific molecules with two CD137 Fab fragments.
Figure 8B:
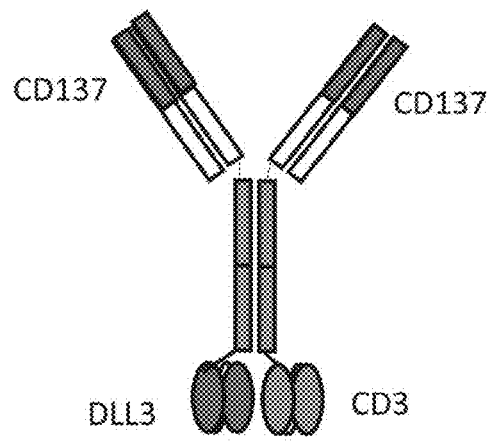
Figure 8C:
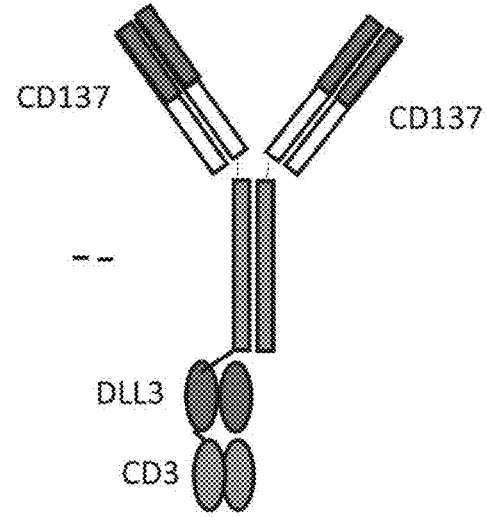

FIG. 8A-8C depict bispecifc and trispecific molecules with two CD137 Fab fragments. FIG. 8A depicts an anti-CD137, anti-DLL3, anti-DLL3 (Fab-Fc-Scfv) molecule. FIG. 8B depicts an anti-CD137, anti-DLL3, anti-CD3 (Fab-Fc-Scfv×Fab-Fc-Scfv) molecule. FIG. 8C depicts an anti-CD137, anti-DLL3, anti-CD3 (Fab-Fc-Scfv-Scfv×Fab-Fc) molecule.

Figure 9A:
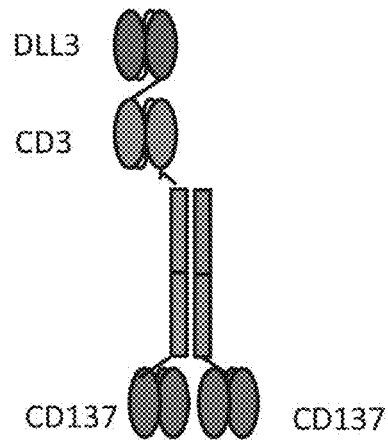
FIG. 9A-9F depict bispecific molecules and trispecific molecules with two CD137 scfv fragments.
Figure 9B:
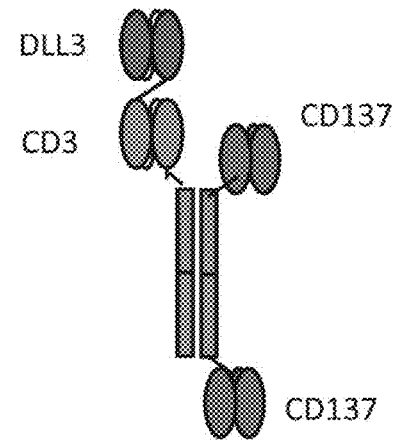
Figure 9C:
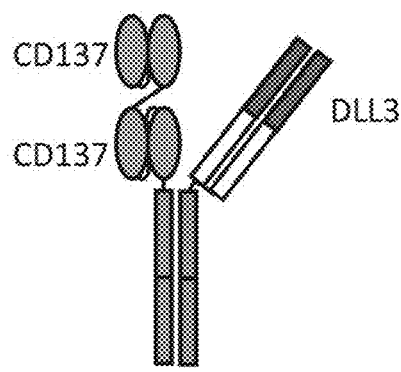
Figure 9D:
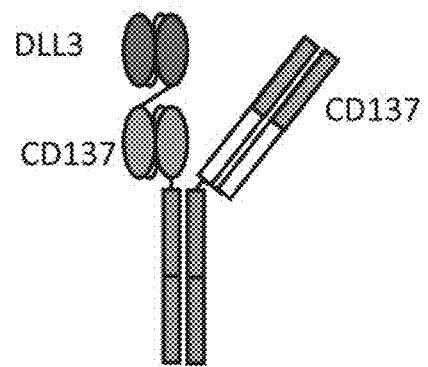
Figure 9E:
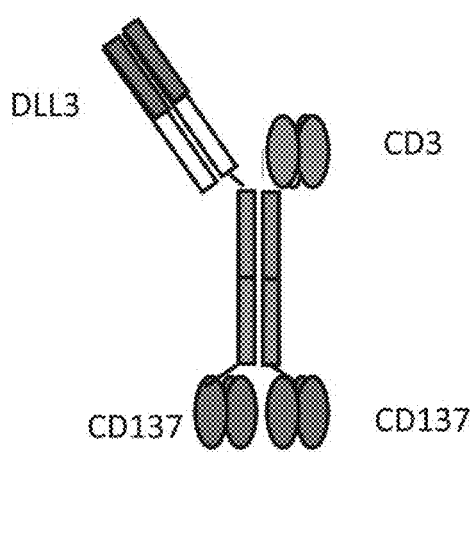
Figure 9F:
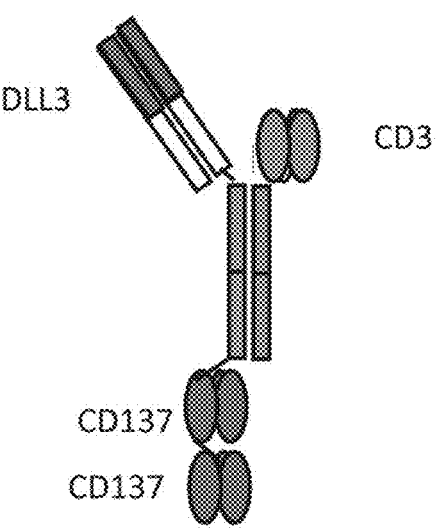

FIG. 9A-9F depict trispecific molecules with two CD137 fragments. FIG. 9A depicts an anti-DLL3, anti-CD3, anti-CD137, anti-CD137 (scfv-scfv-Fc-Scfv×Fc-Scfv) molecule. FIG. 9B depicts an anti-DLL3, anti-CD3, anti-CD137, anti-CD137 (scfv-scfv-Fc×Scfv-Fc-Scfv) molecule. FIG. 9C depicts an anti-CD137, anti-CD137, anti-DLL3 (scfv-scfv-Fc×Fab-Fc) molecule. FIG. 9D depicts an anti-DLL3, anti-CD137, anti-CD137 (scfv-scfv-Fc×Fab-Fc) molecule. FIG. 9E depicts an anti-DLL3, anti-CD3, anti-DLL3, anti-CD137 (Fab-Fc-Scfv×Scfv-Fc-Scfv) molecule. FIG. 9F depicts an anti-DLL3, anti-CD3, anti-CD137, anti-CD137 (Fab-Fc-Scfv-Scfv×Scfv-Fc) molecule.

MUC17 T-Cell Engagers

FIGS. 10A-10R, 18A-18D and 19A-19I depict several formats for trispecific molecules of the invention.

Figure 10M:
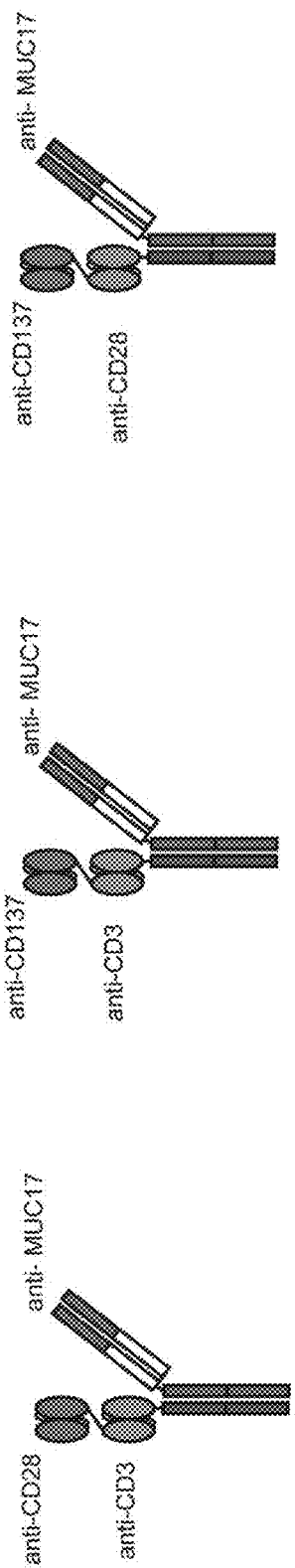
FIG. 10M depicts an anti-CD28, anti-CD3, anti-MUC17 (scfv-scfv-FcxFab-Fc) molecule.
Figure 10N:
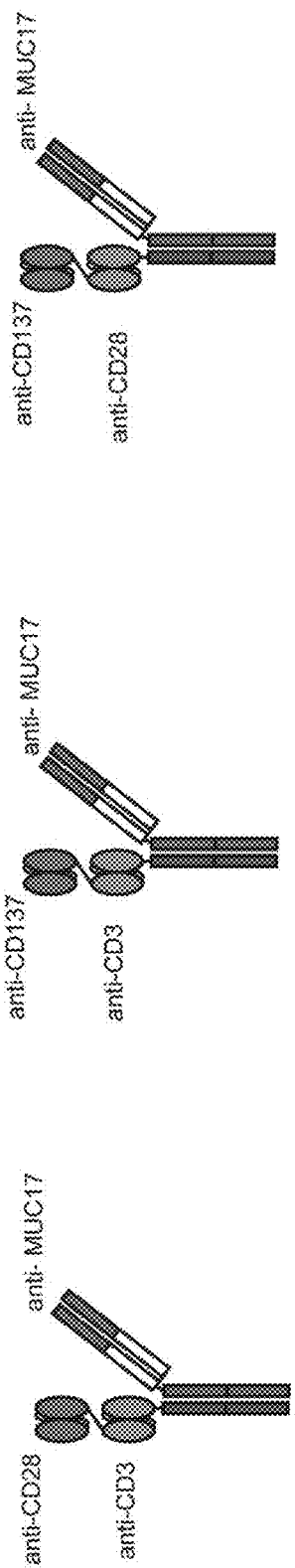
FIG. 10N depicts an anti-CD137, anti-CD3, anti-MUC17 (scfv-scfv-FcxFab-Fc) molecule.
Figure 10O:
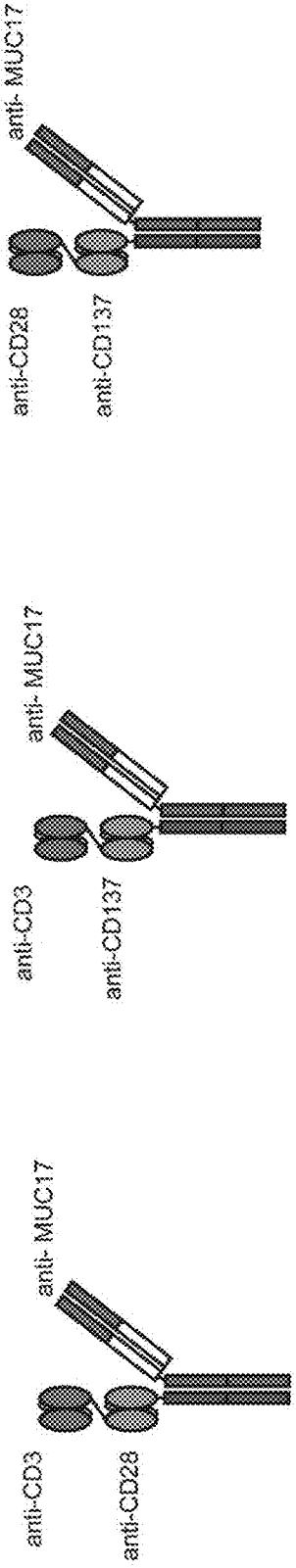
FIG. 10O depicts an anti-CD137, anti-CD28, anti-MUC17 (scfv-scfv-FcxFab-Fc) molecule.
Figure 10P:
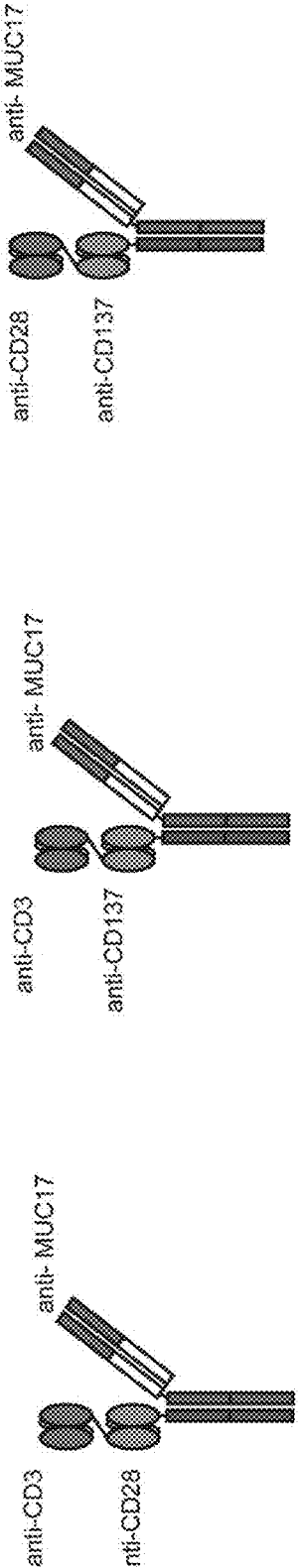
FIG. 10P depicts an anti-CD3, anti-CD28, anti-MUC17 (scfv-scfv-FcxFab-Fc) molecule.
Figure 10Q:
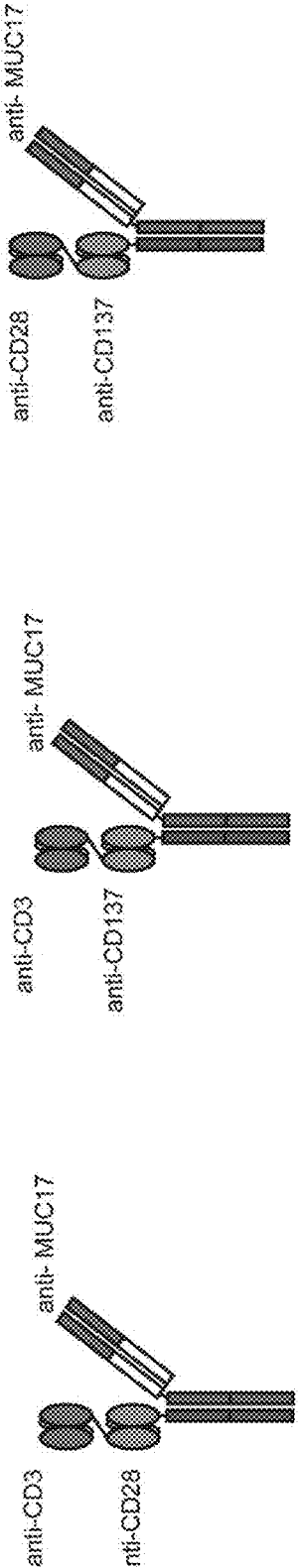
FIG. 10Q depicts an anti-CD3, anti-CD137, anti-MUC17 (scfv-scfv-FcxFab-Fc) molecule.
Figure 10R:
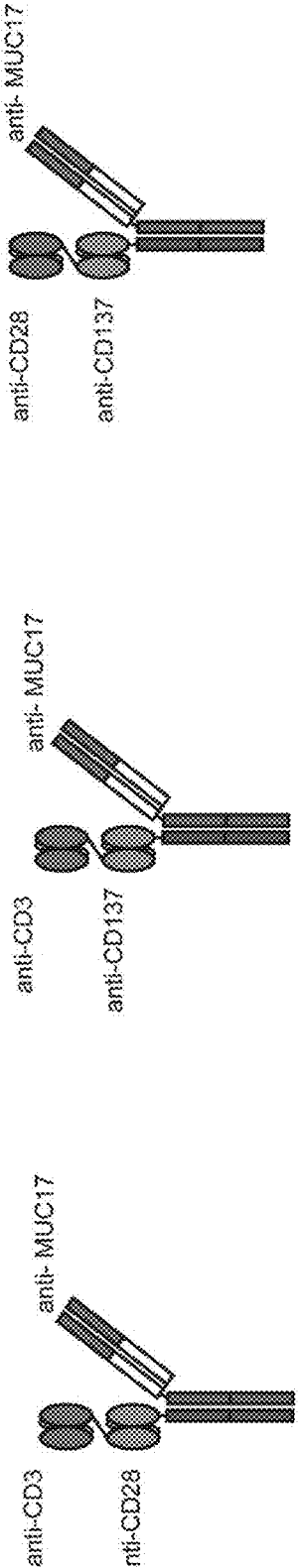
FIG. 10R depicts an anti-CD28, anti-CD137, anti-MUC17 (scfv-scfv-FcxFab-Fc) molecule.

FIG. 10A-10R depict trispecific molecules with combinations of an anti-MUC17 with anti-CD3, anti-CD28 and anti-CD137 in the Scfv-scfv-Fc×Fab-Fc configuration. FIG. 10A-10F depict trispecific with the configuration scfv-MUC17scfv-Fc×Fab-Fc. FIG. 1G-1L depict trispecific molecules with the configuration MUC17scfv-scfv-Fc×Fab-Fc. FIG. 1M-1R depict depict trispecific molecules with the configuration scfv-scfv-Fc×MUC17Fab-Fc.

FIG. 18A-18D depict Muc17×CD137 and DLL3×CD137 bispecifc molecules

FIG. 19A-19C depict trispecific molecules with two CD137 Fab fragments. FIG. 19A depicts an anti-CD137, anti-MUC17, anti-MUC17 (Fab-Fc-Scfv-Scfv) molecule. FIG. 19B depicts an anti-CD137, anti-MUC17, anti-CD3 (Fab-Fc-Scfv×Fab-Fc-Scfv) molecule. FIG. 19C depicts an anti-CD137, anti-MUC17, anti-CD3 (Fab-Fc-Scfv-Scfv×Fab-Fc) molecule. FIG. 19D-19I depict bispecific molecules and trispecific molecules with two CD137 scfv fragments. FIG. 19D depicts an anti-anti-CD137, anti-CD137, anti-MUC17 (scfv-scfv-Fc×Fab-Fc) molecule. FIG. 19E depicts an anti-MUC17, anti-CD137, anti-CD137 (scfv-scfv-Fc×Fab-Fc) molecule. FIG. 19F depicts an anti-MUC17, anti-CD137, CD3, CD137 (Fab-Fc-Scfv×Scfv-Fc-Scfv) molecule. FIG. 19G depicts an anti-MUC17, anti-CD137, anti-CD137, CD3 (Fab-Fc-Scfv-Scfv×Scfv-Fc) molecule. FIG. 19H depicts an anti-MUC17, anti-CD3, anti-CD137, anti-CD137 (scfv-scfv-FScfv×Fc-Scfv) molecule. FIG. 19I depicts an anti-DLL3, anti-CD3, anti-MUC17 (scfv-scfv-Fc×Scfv-Fc-Scfv) molecule.

In an embodiment, the trispecific molecule can be co-administered or combined with an antagonist such as PD1, PDL1, TIGIT, LAG3, TIM3, VISTA or CTLA4. Alternatively, the trispecific molecule can be co-administered or combined with a bispecific antagonist such as PD1×TIGIT, LAG3×TIGIT, PD1×LAG3, PD1×TIM3 or VEGF×TGFBR2. The trispecific molecule can also be co-administered or combined with an agonist such as CD40, GITR, CD27, OX40 or 4-1BB.

CLDN18.2 T-Cell Engagers

Embodiments of the invention include bispecific and trispecific monoclonal antibodies (BSMAbs and TSMAbs, respectively). The single chain variable fragment (scFv) of a first antibody can be joined with the antigen binding fragment (Fab) of a second antibody. For example, the scFv portion of an antibody against CD3 can be linked to a Fab portion of an antibody against CLDN8.2. They can be joined with 4×GKPGS or 4×G4S linkers. The IgG1 Fc can be heterodimerized with charge pair or "knob into hole" mutations or charge pair mutations. The Fc effector function can be minimized through the introduction of N297A/G mutations or LLP mutations. The combination can bring an effector cell (T-cell or NK cell) into the proximity of the tumor cell to enhance antitumor effect.

CD28 signaling is essential for the activity of anti-PD1 and anti-PDL1 antibodies, thus co-dosing the CLDN18.2×CD28 trispecific molecules with anti-PD1 and anti-PDL1 can improve the responses to the inhibition of the PD1/PDL1 pathway. CD137 is highly expressed on exhausted T cells, which cannot be stimulated by PD1/PDL1 stimulation alone. However, CLDN18.2×CD137 or CLDN18.2×CD28×CD137 stimulation combined with PD-1 blockade results in robust antitumor immunity.

FIGS. 20A-20R and 25A-25I depict several formats for trispecific molecules of the invention. The CLDN18.2×CD3 trispecific molecules can activate T cell cytotoxicity against CLDN18.2 expressing CHO cells or NCI-H82 tumor cells. This is exemplified by the release of LDH upon cell death, as well as the upregulation of CD25 on the T cells. When combined with CLDN18.2×CD28 or CLDN18.2×CD137 trispecific molecules, the T cells are further activated, proliferate, and release IFN gamma and IL-2.

Figure 20A:
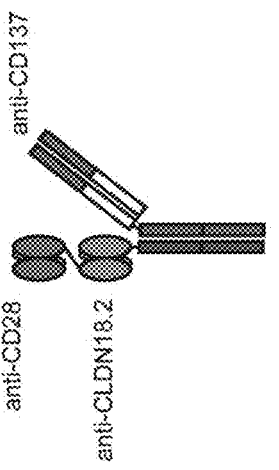
FIG. 20A to 20R depict Scfv-scfv-FcxFab-Fc formats for the trispecific molecules of the invention.
Figure 20B:
FIG. 20B depicts an anti-CD3, anti-CLDN18.2, anti-CD137 (scfv-scfv-FcxFab-Fc) molecule.
Figure 20C:
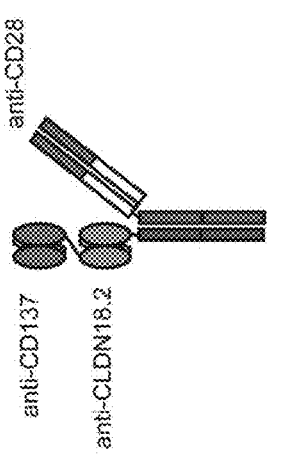
FIG. 20C depicts an anti-CD28, anti-CLDN18.2, anti-CD137 (scfv-scfv-FcxFab-Fc) molecule.
Figure 20D:
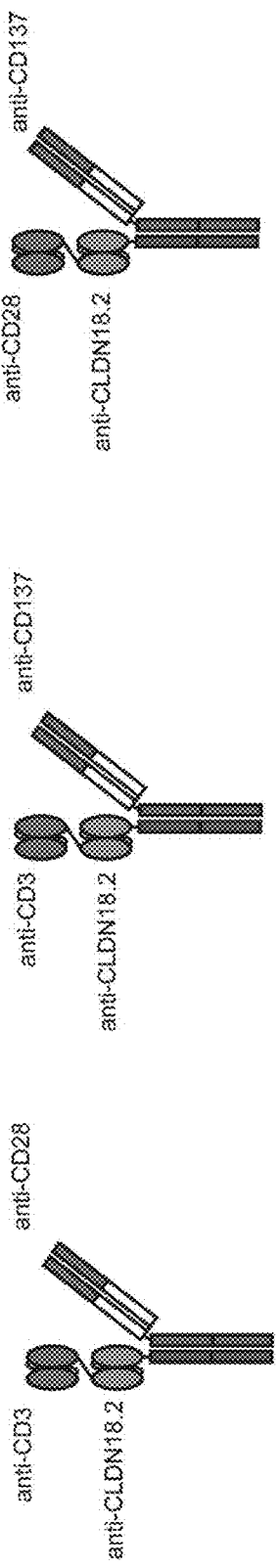
FIG. 20D depicts an anti-CD28, anti-CLDN18.2, anti-CD3 (scfv-scfv-FcxFab-Fc) molecule.
Figure 20E:
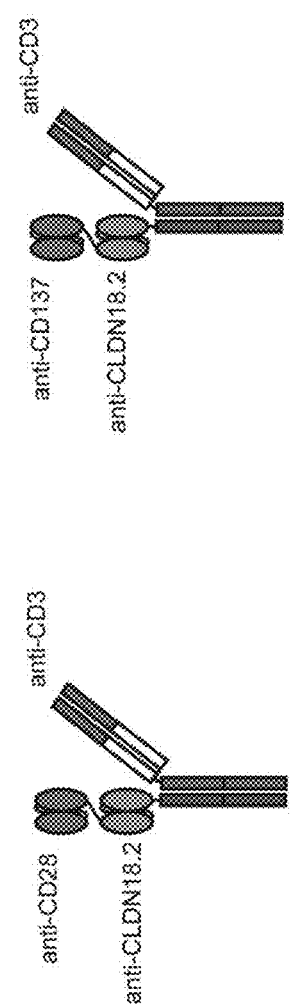
FIG. 20E depicts an anti-CD137, anti-CLDN18.2, anti-CD3 (scfv-scfv-FcxFab-Fc) molecule.
Figure 20F:
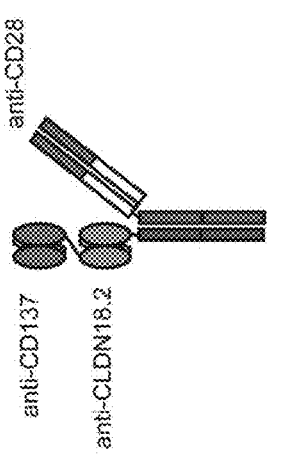
FIG. 20F depicts an anti-CD137, anti-CLDN18.2, anti-CD28 (scfv-scfv-FcxFab-Fc) molecule.
Figure 20M:
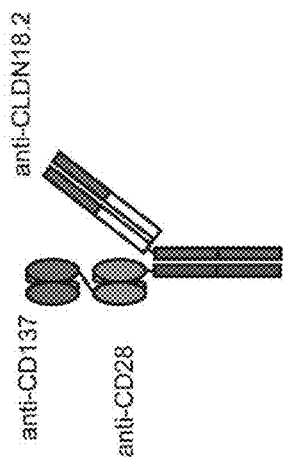
FIG. 20M depicts an anti-CD28, anti-CD3, anti-CLDN18.2 (scfv-scfv-FcxFab-Fc) molecule.
Figure 20N:
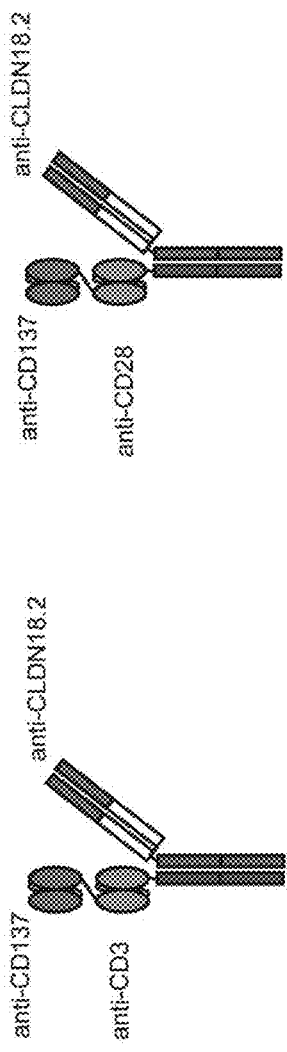
FIG. 20N depicts an anti-CD137, anti-CD3, anti-CLDN18.2 (scfv-scfv-FcxFab-Fc) molecule.
Figure 20O:
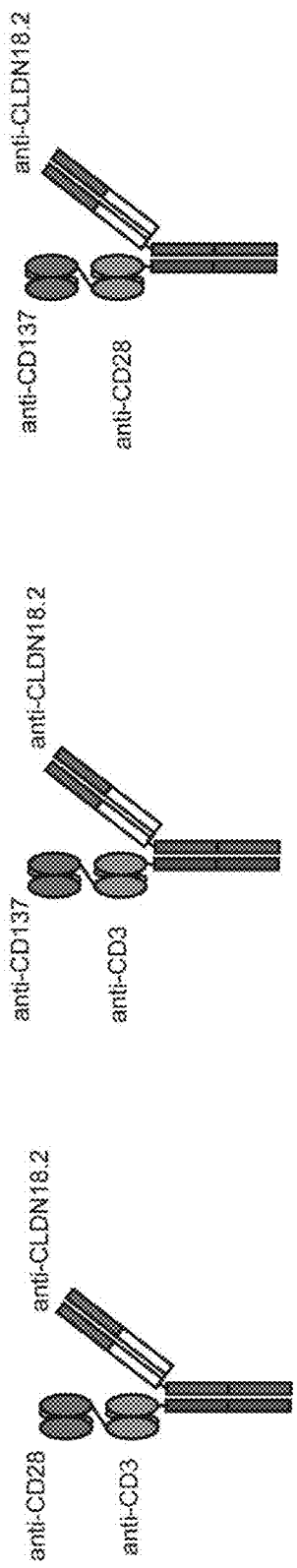
FIG. 20O depicts an anti-CD137, anti-CD28, anti-CLDN18.2 (scfv-scfv-FcxFab-Fc) molecule.
Figure 20P:
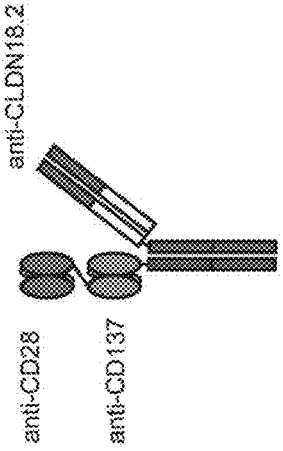
FIG. 20P depicts an anti-CD3, anti-CD28, anti-CLDN18.2 (scfv-scfv-FcxFab-Fc) molecule.
Figure 20Q:
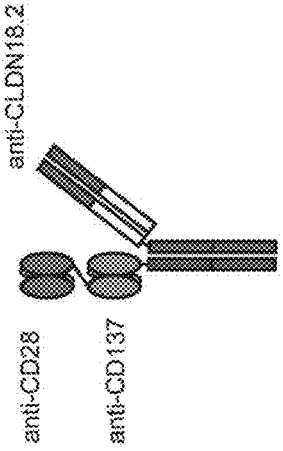
FIG. 20Q depicts an anti-CD3, anti-CD137, anti-CLDN18.2 (scfv-scfv-FcxFab-Fc) molecule.
Figure 20R:
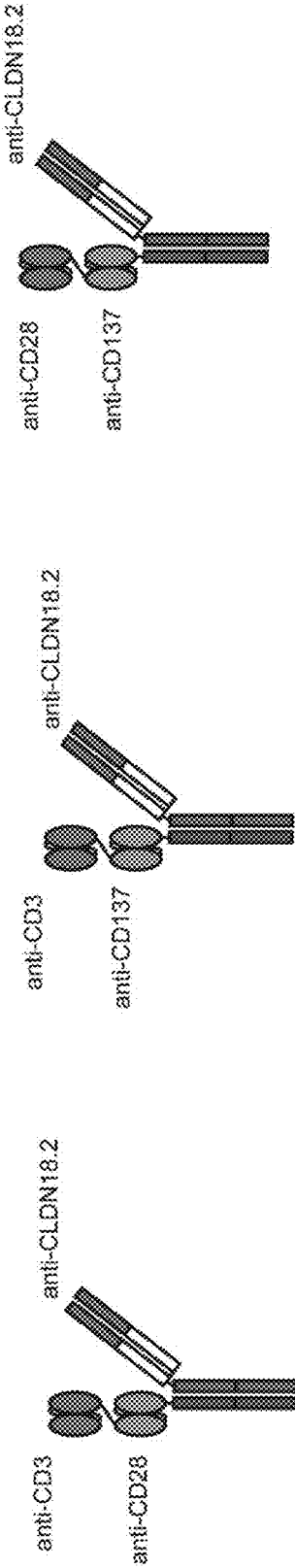

FIG. 20A-20R depict trispecific molecules with combinations of an anti-CLDN18.2 with anti-CD3, anti-CD28 and anti-CD137 in the Scfv-scfv-Fc×Fab-Fc configuration. FIG. 20A-20F depict trispecific with the configuration scfv-CLDn18.1scfv-Fc×Fab-Fc. FIG. 20G-20L depict trispecific molecules with the configuration CLDN18.2scfv-scfv-Fc×Fab-Fc. FIG. 20M-20R depict depict trispecific molecules with the configuration scfv-scfv-Fc×CLDN18.2Fab-Fc.

FIG. 25A-25C depict CLDN18.2 bispecific and trispecific molecules with two CD137 Fab fragments.

FIG. 25A depicts an anti-CD137, anti-CLDN18.2, anti-CLDN (Fab-Fc-Scfv) molecule. FIG. 25B depicts an anti-CD137, anti-CLDN18.2, anti-CD3 (Fab-Fc-Scfv×Fab-Fc-Scfv) molecule. FIGS. 25D and 25E depict trispecific molecules with two CD137 fragments.

FIG. 25D depicts an anti-CD137, anti-CD137, anti-CLDN18.2 bispecific molecule (Scfv-Scfv-Fc×Fab-Fc). Similarly, FIG. 25E depicts an anti-CLDN18.2, anti-CD137, anti-CD137, trispecific molecule (Scfv-Scfv-Fc×Fab-Fc)

FIG. 25F-25I depict trispecific molecules with two CD137 scfv fragments. FIG. 25F depicts an anti-CLDN18.2, anti-CD3, anti-CD137, anti-CD137 (Fab-Fc-Scfv×ScfvFc-Scfv) molecule. FIG. 25G depicts an anti-CLDN18.2, anti-CD3, anti-CD137, anti-CD137 (Fab-Fc-Scfv-Scfv×Scfv-Fc) molecule. FIG. 25H depicts an anti-CLDN18.2, anti-CD3, anti-CD137, anti-CD137 (scfv-scfv-Fc-Scfv×Fc-Scfv) molecule. FIG. 25I depicts an anti-CLDN18.2, anti-CD3, anti-CD137, anti-CD137 (scfv-scfv-FcxScfv-Fc-Scfv) molecule.

In an embodiment, the trispecific molecule can be co-administered or combined with an antagonist such as PD1, PDL1, TIGIT, LAG3, TIM3, VISTA or CTLA4. Alternatively, the trispecific molecule can be co-administered or combined with a bispecific antagonist such as PD1×TIGIT, LAG3×TIGIT, PD1×LAG3, PD1×TIM3 or VEGFx TGFBR2. The trispecific molecule can also be co-administered or combined with an agonist such as CD40, GITR, CD27, OX40 or 4-1BB.

Methods from Producing Trispecific T-Cell Engagers

Another aspect relates to a method for producing a trispecific antibody comprising culturing a cell transiently or stably expressing one or more constructs encoding one or more polypeptide chains in the trispecific antibody; and purifying the trispecific antibody from the cultured cells. Any cell capable of producing a functional trispecific antibody can be used. In preferred embodiments, the trispecific antibody-expressing cell is of eukaryotic or mammalian origin, preferably a human cell or Chinese hamster cell. Cells from various tissue cell types may be used to express the trispecific antibodies. In other embodiments, the cell is a yeast cell, an insect cell or a bacterial cell. Preferably, the trispecific antibody-producing cell is stably transformed with a vector expressing the trispecific antibody.

One or more expression vectors encoding the antibody heavy or light chains can be introduced into a cell by any conventional method, such as by naked DNA technique, cationic lipid-mediated transfection, polymer-mediated transfection, peptide-mediated transfection, virus-mediated infection, physical or chemical agents or treatments, electroporation, etc. In addition, cells may be transfected with one or more expression vectors for expressing the trispecific antibody along with a selectable marker facilitating selection of stably transformed clones expressing the trispecific antibody. The antibodies produced by such cells may be collected and/or purified according to techniques known in the art, such as by centrifugation, chromatography, etc.

Examples of suitable selectable markers for mammalian cells include dihydrofolate reductase (DHFR), thymidine kinase, neomycin, neomycin analog G418, hydromycin, zeocin, blasticidin, and puromycin. When such selectable markers are successfully transferred into a mammalian host cell, the transformed mammalian host cell can survive if placed under selective pressure. There are two widely used distinct categories of selective regimes. The first category is based on a cell's metabolism and the use of a mutant cell line which lacks the ability to grow independent of a supplemented media. Two examples are CHO DHFR cells and mouse LTK cells. These cells lack the ability to grow without the addition of such nutrients as thymidine or hypoxanthine. Because these cells lack certain genes necessary for a complete nucleotide synthesis pathway, they cannot survive unless the missing nucleotides are provided in a supplemented media. An alternative to supplementing the media is to introduce an intact DHFR or TK gene into cells lacking the respective genes, thus altering their growth requirements. Individual cells which were not transformed with the DHFR or TK gene will not be capable of survival in non-supplemented media.

The second category is dominant selection which refers to a selection scheme used in any cell type and does not require the use of a mutant cell line. These schemes typically use a drug to arrest growth of a host cell. Those cells which have a novel gene would express a protein conveying drug resistance and would survive the selection. Examples of such dominant selection use the drugs neomycin, mycophenolic acid, or hygromycin. The three examples employ bacterial genes under eukaryotic control to convey resistance to the appropriate drug G418 or neomycin (geneticin), xgpt (mycophenolic acid) or hygromycin, respectively. Others include the neomycin analog G418 and puromycin.

Exemplary trispecific antibody-expressing cells include human Jurkat, human embryonic kidney (HEK) 293, Chinese hamster ovary (CHO) cells, mouse WEHI fibrosarcoma cells, as well as unicellular protozoan species, such as *Leishmania tarentolae*. In addition, stably transformed, antibody producing cell lines may be produced using primary cells immortalized with c-myc or other immortalizing agents.

In some embodiments, the cell lines express at least 1 mg, at least 2 mg, at least 5 mg, at least 10 mg, at least 20 mg, at least 50 mg, at least 100 mg, at least 500 mg, at least 1 gram, at least 2 grams, at least 4 grams, or at least 10 grams of the trispecific antibody/liter of culture. Trispecific antibodies can be isolated from trispecific antibody expressing cells following culture and maintenance in any appropriate culture medium, such as RPMI, DMEM, and AIM V®. The trispecific antibodies can be purified using conventional protein purification methodologies (e.g., affinity purification, chromatography, etc.), including the use of Protein-A or Protein-G immunoaffinity purification. In some embodiments, trispecific antibodies are engineered for secretion into culture supernatants for isolation therefrom.

Methods of Treatment

Another aspect of the present application relates to a method for treating a cell proliferative disorder. The method comprises administering to a subject in need thereof an effective amount of a trispecific antibody according to the present disclosure. In another aspect, a method for treating a cell proliferative disorder comprises administering to a subject in need thereof an effective amount of one or more expression vectors expressing a trispecific antibody according to the present disclosure.

Any suitable route or mode of administration can be employed for providing the patient with a therapeutically or prophylactically effective dose of the trispecific antibody. Exemplary routes or modes of administration include parenteral {e.g., intravenous, intraarterial, intramuscular, subcutaneous, intratumoral), oral, topical (nasal, transdermal, intradermal or intraocular), mucosal {e.g., nasal, sublingual, buccal, rectal, vaginal), inhalation, intralymphatic, intraspinal, intracranial, intraperitoneal, intratracheal, intravesical, intrathecal, enteral, intrapulmonary, intralymphatic, intracavital, intraorbital, intracapsular and transurethral, as well as local delivery by catheter or stent.

A pharmaceutical composition comprising a trispecific antibody in accordance with the present disclosure can be formulated in any pharmaceutically acceptable carrier(s) or excipient(s). As used herein, the term "pharmaceutically acceptable carrier" includes any and all solvents, dispersion media, coatings, antibacterial and antifungal agents, isotonic and absorption delaying agents, and the like that are physiologically compatible. Pharmaceutical compositions can include suitable solid or gel phase carriers or excipients. Exemplary carriers or excipients include calcium carbonate, calcium phosphate, various sugars, starches, cellulose derivatives, gelatin, and polymers such as polyethylene glycols. Exemplary pharmaceutically acceptable carriers include one or more of water, saline, phosphate buffered saline, dextrose, glycerol, ethanol and the like, as well as combinations thereof. In many cases it will be preferable to include isotonic agents, for example, sugars, polyalcohols such as mannitol, sorbitol, or sodium chloride in the composition. Pharmaceutically acceptable carriers can further comprise minor amounts of auxiliary substances such as wetting or emulsifying agents, preservatives or buffers, which enhance the shelf life or effectiveness of the therapeutic agents.

The trispecific antibody can be incorporated into a pharmaceutical composition suitable for parenteral administration. Suitable buffers include but are not limited to, sodium succinate, sodium citrate, sodium phosphate or potassium phosphate. Sodium chloride can be used to modify the toxicity of the solution at a concentration of 0-300 mM (optimally 150 mM for a liquid dosage form). Cryoprotectants can be included for a lyophilized dosage form, principally 0-10% sucrose (optimally 0.5-1.0%). Other suitable cryoprotectants include trehalose and lactose. Bulking agents can be included for a lyophilized dosage form, principally 1-10% mannitol (optimally 2-4%). Stabilizers can be used in both liquid and lyophilized dosage forms, principally 1-50 mM L-Methionine (optimally 5-10 mM). Other suitable bulking agents include glycine, arginine, can be included as 0-0.05%>polysorbate-80 (optimally 0.005-0.01%). Additional surfactants include but are not limited to polysorbate 20 and BRIJ surfactants.

Therapeutic trispecific antibody preparations can be lyophilized and stored as sterile powders, preferably under vacuum, and then reconstituted in bacteriostatic water (containing, for example, benzyl alcohol preservative) or in sterile water prior to injection. Pharmaceutical compositions can be formulated for parenteral administration by injection e.g., by bolus injection or continuous infusion.

The therapeutic agents in the pharmaceutical compositions may be formulated in a "therapeutically effective amount" or a "prophylactically effective amount". A "therapeutically effective amount" refers to an amount effective, at dosages and for periods of time necessary, to achieve the desired therapeutic result. A therapeutically effective amount of the recombinant vector may vary depending on the condition to be treated, the severity and course of the condition, the mode of administration, whether the antibody or agent is administered for preventive or therapeutic purposes, the bioavailability of the particular agent(s), the ability of the trispecific antibody to elicit a desired response in the individual, previous therapy, the age, weight and sex of the patient, the patient's clinical history and response to the antibody, the type of the trispecific antibody used, discretion of the attending physician, etc. A therapeutically effective amount is also one in which any toxic or detrimental effects of the recombinant vector is outweighed by the therapeutically beneficial effects. A "prophylactically effective amount" refers to an amount effective, at dosages and for periods of time necessary, to achieve the desired prophylactic result.

Preferably, the polypeptide domains in the trispecific antibody are derived from the same host in which they are to be administered in order to reduce inflammatory responses against the administered therapeutic agents.

The trispecific antibody is suitably administered to the patent at one time or over a series of treatments and may be administered to the patient at any time from diagnosis onwards. The trispecific antibody may be administered as the sole treatment or in conjunction with other drugs or therapies useful in treating the condition in question.

As a general proposition, a therapeutically effective amount or prophylactically effective amount of the trispecific antibody will be administered in a range from about 1 ng/kg body weight/day to about 100 mg/kg body weight/day whether by one or more administrations. In a particular embodiment, each trispecific antibody is administered in the range of from about 1 ng/kg body weight/day to about 10 mg/kg body weight/day, about 1 ng/kg body weight/day to about 1 mg/kg body weight/day, about 1 ng/kg body weight/day to about 100 g/kg body weight/day, about 1 ng/kg body weight/day to about 10 g/kg body weight/day, about 1 ng/kg body weight/day to about 1 g/kg body weight/day, about 1 ng/kg body weight/day to about 100 ng/kg body weight/day, about 1 ng/kg body weight/day to about 10 ng/kg body weight/day, about 10 ng/kg body weight/day to about 100 mg/kg body weight/day, about 10 ng/kg body weight/day to about 10 mg/kg body weight/day, about 10 ng/kg body weight/day to about 1 mg/kg body weight/day, about 10 ng/kg body weight/day to about 100 g/kg body weight/day, about 10 ng/kg body weight/day to about 10 mg/kg body weight/day, about 10 ng/kg body weight/day to about 1 mg/kg body weight/day, 10 ng/kg body weight/day to about 100 ng/kg body weight/day, about 100 ng/kg body weight/day to about 100 mg/kg body weight/day, about 100 ng/kg body weight/day to about 10 mg/kg body weight/day, about 100 ng/kg body weight/day to about 1 mg/kg body weight/day, about 100 ng/kg body weight/day to about 100 mg/kg body weight/day, about 100 ng/kg body weight/day to about 10 mg/kg body weight/day, about 100 ng/kg body weight/day to about 1 mg/kg body weight/day to about 100 mg/kg body weight/day, about 1 mg/kg body weight/day to about 10 mg/kg body weight/day, about 1 mg/kg body weight/day to about 1 mg/kg body weight/day, about 1 mg/kg body weight/day to about 100 mg/kg body weight/day, about 1 mg/kg body weight/day to about 10 mg/kg body weight/day, about 10 mg/kg body weight/day to about 100 mg/kg body weight/day, about 10 mg/kg body weight/day to about 10 mg/kg body weight/day, about 10 mg/kg body weight/day to about 1 mg/kg body weight/day, about 10 mg/kg body weight/day to about 100 mg/kg body weight/day, about 100 mg/kg body weight/day to about 100 mg/kg body weight/day, about 100 mg/kg body weight/day to about 10 mg/kg body weight/day, about 100 mg/kg body weight/day to about 1 mg/kg body weight/day, about 1 mg/kg body weight/day to about 100 mg/kg body weight/day, about 1 mg/kg body weight/day to about 10 mg/kg body weight/day, about 10 mg/kg body weight/day to about 100 mg/kg body weight/day.

In other embodiments, the trispecific antibody is administered at a dose of 500 g to 20 g every three days, or 25 mg/kg body weight every three days.

In other embodiments, each trispecific antibody is administered in the range of about 10 ng to about 100 ng per individual administration, about 10 ng to about 1 g per individual administration, about 10 ng to about 10 g per individual administration, about 10 ng to about 100 mg per individual administration, about 10 ng to about 1 mg per individual administration, about 10 ng to about 10 mg per individual administration, about 10 ng to about 100 mg per individual administration, about 10 ng to about 1000 mg per injection, about 10 ng to about 10,000 mg per individual administration, about 100 ng to about 1 mg per individual administration, about 100 ng to about 10 mg per individual administration, about 100 ng to about 100 mg per individual administration, about 100 ng to about 1 mg per individual administration, about 100 ng to about 10 mg per individual administration, about 100 ng to about 100 mg per individual administration, about 100 ng to about 1000 mg per injection, about 100 ng to about 10,000 mg per individual administration, about 1 mg to about 10 mg per individual administration, about 1 mg to about 100 mg per individual administration, about 1 mg to about 1 mg per individual administration, about 1 mg to about 10 mg per individual administration, about 1 mg to about 100 mg per individual administration, about 1 mg to about 1000 mg per injection, about 1 mg to about 10,000 mg per individual administration, about 10 mg to about 100 mg per individual administration, about 10 mg to about 1 mg per individual administration, about 10 mg to about 10 mg per individual administration, about 10 mg to about 100 mg per individual administration, about 10 mg to about 1000 mg per injection, about 10 mg to about 10,000 mg per individual administration, about 100 mg to about 1 mg per individual administration, about 100 mg to about 10 mg per individual administration, about 100 mg to about 100 mg per individual administration, about 100 mg to about 1000 mg per injection, about 100 mg to about 10,000 mg per individual administration, about 1 mg to about 10 mg per individual administration, about 1 mg to about 100 mg per individual administration, about 1 mg to about 1000 mg per injection, about 1 mg to about 10,000 mg per individual administration, about 10 mg to about 100 mg per individual administration, about 10 mg to about 1000 mg per injection, about 10 mg to about 10,000 mg per individual administration, about 100 mg to about 1000 mg per injection, about 100 mg to about 10,000 mg per individual administration and about 1000 mg to about 10,000 mg per individual administration. The trispecific antibody may be administered daily, every 2, 3, 4, 5, 6 or 7 days, or every 1, 2, 3 or 4 weeks.

In other particular embodiments, the amount of the trispecific antibody may be administered at a dose of about 0.0006 mg/day, 0.001 mg/day, 0.003 mg/day, 0.006 mg/day, 0.01 mg/day, 0.03 mg/day, 0.06 mg/day, 0.1 mg/day, 0.3 mg/day, 0.6 mg/day, 1 mg/day, 3 mg/day, 6 mg/day, 10 mg/day, 30 mg/day, 60 mg/day, 100 mg/day, 300 mg/day, 600 mg/day, 1000 mg/day, 2000 mg/day, 5000 mg/day or 10,000 mg/day. As expected, the dosage will be dependent on the condition, size, age and condition of the patient.

In certain embodiments, the coding sequences for a trispecific antibody are incorporated into a suitable expression vector (e.g., viral or non-viral vector) for expressing an effective amount of the trispecific antibody in patient with a cell proliferative disorder. In certain embodiments comprising administration of e.g., one or more recombinant AAV (rAAV) viruses, the pharmaceutical composition may comprise the rAAVs in an amount comprising at least $10^{10}$, at least $10^{11}$, at least $10^{12}$, at least $10^{13}$, or at least $10^{14}$ genome copies (GC) or recombinant viral particles per kg, or any range thereof. In certain embodiments, the pharmaceutical composition comprises an effective amount of the recombinant virus, such as rAAV, in an amount comprising at least $10^{10}$, at least $10^{11}$, at least $10^{12}$, at least $10^{13}$, at least $10^{14}$, at least $10^{15}$ genome copies or recombinant viral particles genome copies per subject, or any range thereof.

Dosages can be tested in several art-accepted animal models suitable for any particular cell proliferative disorder.

Delivery methodologies may also include the use of polycationic condensed DNA linked or unlinked to killed viruses, ligand linked DNA, liposomes, eukaryotic cell delivery vehicles cells, deposition of photopolymerized hydrogel materials, use of a handheld gene transfer particle gun, ionizing radiation, nucleic charge neutralization or fusion with cell membranes, particle mediated gene transfer and the like.

In other aspects of this embodiment, a pharmaceutical composition compound disclosed herein reduces the size of a tumor by, e.g., at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90% or at least 95%. In yet other aspects of this embodiment, a pharmaceutical composition disclosed herein reduces the size of a tumor from, e.g., about 5% to about 100%, about 10% to about 100%, about 20% to about 100%, about 30% to about 100%, about 40% to about 100%, about 50% to about 100%, about 60% to about 100%, about 70% to about 100%, about 80% to about 100%, about 10% to about 90%, about 20% to about 90%, about 30% to about 90%, about 40% to about 90%, about 50% to about 90%, about 60% to about 90%, about 70% to about 90%, about 10% to about 80%, about 20% to about 80%, about 30% to about 80%, about 40% to about 80%, about 50% to about 80%, or about 60% to about 80%, about 10% to about 70%, about 20% to about 70%, about 30% to about 70%, about 40% to about 70%, or about 50% to about 70%.

A pharmaceutical composition disclosed herein is in an amount sufficient to allow customary administration to an individual. In aspects of this embodiment, a pharmaceutical composition disclosed herein may be, e.g., at least 5 mg, at least 10 mg, at least 15 mg, at least 20 mg, at least 25 mg, at least 30 mg, at least 35 mg, at least 40 mg, at least 45 mg, at least 50 mg, at least 55 mg, at least 60 mg, at least 65 mg, at least 70 mg, at least 75 mg, at least 80 mg, at least 85 mg, at least 90 mg, at least 95 mg, or at least 100 mg of a pharmaceutical composition. In other aspects of this embodiment, a pharmaceutical composition disclosed herein may be, e.g., at least 5 mg, at least 10 mg, at least 20 mg, at least 25 mg, at least 50 mg, at least 75 mg, at least 100 mg, at least 200 mg, at least 300 mg, at least 400 mg, at least 500 mg, at least 600 mg, at least 700 mg, at least 800 mg, at least 900 mg, at least 1,000 mg, at least 1,100 mg, at least 1,200 mg, at least 1,300 mg, at least 1,400 mg, or at least 1,500 mg of a pharmaceutical composition. In yet other aspects of this embodiment, a pharmaceutical composition disclosed herein may be in the range of, e.g., about 5 mg to about 100 mg, about 10 mg to about 100 mg, about 50 mg to about 150 mg, about 100 mg to about 250 mg, about 150 mg to about 350 mg, about 250 mg to about 500 mg, about 350 mg to about 600 mg, about 500 mg to about 750 mg, about 600 mg to about 900 mg, about 750 mg to about 1,000 mg, about 850 mg to about 1,200 mg, or about 1,000 mg to about 1,500 mg. In still other aspects of this embodiment, a pharmaceutical composition disclosed herein may be in the range of, e.g., about 10 mg to about 250 mg, about 10 mg to about 500 mg, about 10 mg to about 750 mg, about 10 mg to about 1,000 mg, about 10 mg to about 1,500 mg, about 50 mg to about 250 mg, about 50 mg to about 500 mg, about 50 mg to about 750 mg, about 50 mg to about 1,000 mg, about 50 mg to about 1,500 mg, about 100 mg to about 250 mg, about 100 mg to about 500 mg, about 100 mg to about 750 mg, about 100 mg to about 1,000 mg, about 100 mg to about 1,500 mg, about 200 mg to about 500 mg, about 200 mg to about 750 mg, about 200 mg to about 1,000 mg, about 200 mg to about 1,500 mg, about 5 mg to about 1,500 mg, about 5 mg to about 1,000 mg, or about 5 mg to about 250 mg.

A pharmaceutical composition disclosed herein may comprise a solvent, emulsion or other diluent in an amount sufficient to dissolve a pharmaceutical composition disclosed herein. In other aspects of this embodiment, a pharmaceutical composition disclosed herein may comprise a solvent, emulsion or a diluent in an amount of, e.g., less than about 90% (v/v), less than about 80% (v/v), less than about 70% (v/v), less than about 65% (v/v), less than about 60% (v/v), less than about 55% (v/v), less than about 50% (v/v), less than about 45% (v/v), less than about 40% (v/v), less than about 35% (v/v), less than about 30% (v/v), less than about 25% (v/v), less than about 20% (v/v), less than about 15% (v/v), less than about 10% (v/v), less than about 5% (v/v), or less than about 1% (v/v). In other aspects of this embodiment, a pharmaceutical composition disclosed herein may comprise a solvent, emulsion or other diluent in an amount in a range of, e.g., about 1% (v/v) to 90% (v/v), about 1% (v/v) to 70% (v/v), about 1% (v/v) to 60% (v/v), about 1% (v/v) to 50% (v/v), about 1% (v/v) to 40% (v/v), about 1% (v/v) to 30% (v/v), about 1% (v/v) to 20% (v/v), about 1% (v/v) to 10% (v/v), about 2% (v/v) to 50% (v/v), about 2% (v/v) to 40% (v/v), about 2% (v/v) to 30% (v/v), about 2% (v/v) to 20% (v/v), about 2% (v/v) to 10% (v/v), about 4% (v/v) to 50% (v/v), about 4% (v/v) to 40% (v/v), about 4% (v/v) to 30% (v/v), about 4% (v/v) to 20% (v/v), about 4% (v/v) to 10% (v/v), about 6% (v/v) to 50% (v/v), about 6% (v/v) to 40% (v/v), about 6% (v/v) to 30% (v/v), about 6% (v/v) to 20% (v/v), about 6% (v/v) to 10% (v/v), about 8% (v/v) to 50% (v/v), about 8% (v/v) to 40% (v/v), about 8% (v/v) to 30% (v/v), about 8% (v/v) to 20% (v/v), about 8% (v/v) to 15% (v/v), or about 8% (v/v) to 12% (v/v).

The final concentration of a pharmaceutical composition disclosed herein in a pharmaceutical composition disclosed herein may be of any concentration desired. In an aspect of this embodiment, the final concentration of a pharmaceutical composition in a pharmaceutical composition may be a therapeutically effective amount. In other aspects of this embodiment, the final concentration of a pharmaceutical composition in a pharmaceutical composition may be, e.g., at least 0.00001 mg/mL, at least 0.0001 mg/mL, at least 0.001 mg/mL, at least 0.01 mg/mL, at least 0.1 mg/mL, at least 1 mg/mL, at least 10 mg/mL, at least 25 mg/mL, at least 50 mg/mL, at least 100 mg/mL, at least 200 mg/mL or at least 500 mg/mL. In other aspects of this embodiment, the final concentration of a pharmaceutical composition in a pharmaceutical composition may be in a range of, e.g., about 0.00001 mg/mL to about 3,000 mg/mL, about 0.0001 mg/mL to about 3,000 mg/mL, about 0.01 mg/mL to about 3,000 mg/mL, about 0.1 mg/mL to about 3,000 mg/mL, about 1 mg/mL to about 3,000 mg/mL, about 250 mg/mL to about 3,000 mg/mL, about 500 mg/mL to about 3,000 mg/mL, about 750 mg/mL to about 3,000 mg/mL, about 1,000 mg/mL to about 3,000 mg/mL, about 100 mg/mL to about 2,000 mg/mL, about 250 mg/mL to about 2,000 mg/mL, about 500 mg/mL to about 2,000 mg/mL, about 750 mg/mL to about 2,000 mg/mL, about 1,000 mg/mL to about 2,000 mg/mL, about 100 mg/mL to about 1,500 mg/mL, about 250 mg/mL to about 1,500 mg/mL, about 500 mg/mL to about 1,500 mg/mL, about 750 mg/mL to about 1,500 mg/mL, about 1,000 mg/mL to about 1,500 mg/mL, about 100 mg/mL to about 1,200 mg/mL, about 250 mg/mL to about 1,200 mg/mL, about 500 mg/mL to about 1,200 mg/mL, about 750 mg/mL to about 1,200 mg/mL, about 1,000 mg/mL to about 1,200 mg/mL, about 100 mg/mL to about 1,000 mg/mL, about 250 mg/mL to about 1,000 mg/mL, about 500 mg/mL to about 1,000 mg/mL, about 750 mg/mL to about 1,000 mg/mL, about 100 mg/mL to about 750 mg/mL, about 250 mg/mL to about 750 mg/mL, about 500 mg/mL to about 750 mg/mL, about 100 mg/mL to about 500 mg/mL, about 250 mg/mL to about 500 mg/mL, about 0.00001 mg/mL to about 0.0001 mg/mL, about 0.00001 mg/mL to about 0.001 mg/mL, about 0.00001 mg/mL to about 0.01 mg/mL, about 0.00001 mg/mL to about 0.1 mg/mL, about 0.00001 mg/mL to about 1 mg/mL, about 0.001 mg/mL to about 0.01 mg/mL, about 0.001 mg/mL to about 0.1 mg/mL, about 0.001 mg/mL to about 1 mg/mL, about 0.001 mg/mL to about 10 mg/mL, or about 0.001 mg/mL to about 100 mg/mL.

Aspects of the present specification disclose, in part, treating an individual suffering from cancer. As used herein, the term "treating," refers to reducing or eliminating in an individual a clinical symptom of cancer; or delaying or preventing in an individual the onset of a clinical symptom of cancer. For example, the term "treating" can mean reducing a symptom of a condition characterized by a cancer, including, but not limited to, tumor size, by, e.g., at least 20%, at least 25%, at least 30%, at least 35%, at least 40%, at least 45%, at least 50%, at least 55%, at least 60%, at least 65%, at least 70%, at least 75%, at least 80%, at least 85%, at least 90% at least 95%, or at least 100%. The actual symptoms associated with cancer are well known and can be determined by a person of ordinary skill in the art by taking into account factors, including, without limitation, the location of the cancer, the cause of the cancer, the severity of the cancer, and/or the tissue or organ affected by the cancer. Those of skill in the art will know the appropriate symptoms or indicators associated with a specific type of cancer and will know how to determine if an individual is a candidate for treatment as disclosed herein.

In another aspect, a pharmaceutical composition disclosed herein reduces the severity of a symptom of a disorder associated with a cancer. In aspects of this embodiment, a pharmaceutical composition disclosed herein reduces the severity of a symptom of a disorder associated with a cancer by, e.g., at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90% or at least 95%. In other aspects of this embodiment, a pharmaceutical composition disclosed herein reduces the severity of a symptom of a disorder associated with a cancer by, e.g., about 10% to about 100%, about 20% to about 100%, about 30% to about 100%, about 40% to about 100%, about 50% to about 100%, about 60% to about 100%, about 70% to about 100%, about 80% to about 100%, about 10% to about 90%, about 20% to about 90%, about 30% to about 90%, about 40% to about 90%, about 50% to about 90%, about 60% to about 90%, about 70% to about 90%, about 10% to about 80%, about 20% to about 80%, about 30% to about 80%, about 40% to about 80%, about 50% to about 80%, or about 60% to about 80%, about 10% to about 70%, about 20% to about 70%, about 30% to about 70%, about 40% to about 70%, or about 50% to about 70%.

In aspects of this embodiment, a therapeutically effective amount of a pharmaceutical composition disclosed herein reduces a symptom associated with cancer by, e.g., at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95% or at least 100%. In other aspects of this embodiment, a therapeutically effective amount of a pharmaceutical composition disclosed herein reduces a symptom associated with cancer by, e.g., at most 10%, at most 15%, at most 20%, at most 25%, at most 30%, at most 35%, at most 40%, at most 45%, at most 50%, at most 55%, at most 60%, at most 65%, at most 70%, at most 75%, at most 80%, at most 85%, at most 90%, at most 95% or at most 100%. In yet other aspects of this embodiment, a therapeutically effective amount of a pharmaceutical composition disclosed herein reduces a symptom associated with cancer by, e.g., about 10% to about 100%, about 10% to about 90%, about 10% to about 80%, about 10% to about 70%, about 10% to about 60%, about 10% to about 50%, about 10% to about 40%, about 20% to about 100%, about 20% to about 90%, about 20% to about 80%, about 20% to about 20%, about 20% to about 60%, about 20% to about 50%, about 20% to about 40%, about 30% to about 100%, about 30% to about 90%, about 30% to about 80%, about 30% to about 70%, about 30% to about 60%, or about 30% to about 50%.

In yet other aspects of this embodiment, a therapeutically effective amount of a pharmaceutical composition disclosed herein generally is in the range of about 0.001 mg/kg to about 100 mg/kg and administered, for example, every 3, 5, 7, 10 or 14 days. In aspects of this embodiment, an effective amount of a pharmaceutical composition disclosed herein may be, e.g., at least 0.001 mg/kg, at least 0.01 mg/kg, at least 0.1 mg/kg, at least 1.0 mg/kg, at least 5.0 mg/kg, at least 10 mg/kg, at least 15 mg/kg, at least 20 mg/kg, at least 25 mg/kg, at least 30 mg/kg, at least 35 mg/kg, at least 40 mg/kg, at least 45 mg/kg, or at least 50 mg/kg and administered, for example, every 3, 5, 7, 10 or 14 days. In other aspects of this embodiment, an effective amount of a pharmaceutical composition disclosed herein may be in the range of, e.g., about 0.001 mg/kg to about 10 mg/kg, about 0.001 mg/kg/day to about 15 mg/kg, about 0.001 mg/kg to about 20 mg/kg, about 0.001 mg/kg to about 25 mg/kg, about 0.001 mg/kg to about 30 mg/kg, about 0.001 mg/kg to about 35 mg/kg, about 0.001 mg/kg to about 40 mg/kg, about 0.001 mg/kg to about 45 mg/kg, about 0.001 mg/kg to about 50 mg/kg, about 0.001 mg/kg to about 75 mg/kg, or about 0.001 mg/kg to about 100 mg/kg and administered, for example, every 3, 5, 7, 10 or 14 days. In yet other aspects of this embodiment, an effective amount of a pharmaceutical composition disclosed herein may be in the range of, e.g., about 0.01 mg/kg to about 10 mg/kg, about 0.01 mg/kg to about 15 mg/kg, about 0.01 mg/kg to about 20 mg/kg, about 0.01 mg/kg to about 25 mg/kg, about 0.01 mg/kg to about 30 mg/kg, about 0.01 mg/kg to about 35 mg/kg, about 0.01 mg/kg to about 40 mg/kg, about 0.01 mg/kg to about 45 mg/kg, about 0.01 mg/kg to about 50 mg/kg, about 0.01 mg/kg to about 75 mg/kg, or about 0.01 mg/kg to about 100 mg/kg and administered, for example, every 3, 5, 7, 10 or 14 days. In still other aspects of this embodiment, an effective amount of a pharmaceutical composition disclosed herein may be in the range of, e.g., about 0.1 mg/kg to about 10 mg/kg, about 0.1 mg/kg to about 15 mg/kg, about 0.1 mg/kg to about 20 mg/kg, about 0.1 mg/kg to about 25 mg/kg, about 0.1 mg/kg to about 30 mg/kg, about 0.1 mg/kg to about 35 mg/kg, about 0.1 mg/kg to about 40 mg/kg, about 0.1 mg/kg to about 45 mg/kg, about 0.1 mg/kg to about 50 mg/kg, about 0.1 mg/kg to about 75 mg/kg, or about 0.1 mg/kg to about 100 mg/kg and administered, for example, every 3, 5, 7, 10 or 14 days.

Dosing can be single dosage or cumulative (serial dosing), and can be readily determined by one skilled in the art. For instance, treatment of a cancer may comprise a one-time administration of an effective dose of a pharmaceutical composition disclosed herein. Alternatively, treatment of a cancer may comprise multiple administrations of an effective dose of a pharmaceutical composition carried out over a range of time periods, such as, e.g., once daily, twice daily, trice daily, once every few days, or once weekly. The timing of administration can vary from individual to individual, depending upon such factors as the severity of an individual's symptoms. For example, an effective dose of a pharmaceutical composition disclosed herein can be administered to an individual once daily for an indefinite period of time, or until the individual no longer requires therapy. A person of ordinary skill in the art will recognize that the condition of the individual can be monitored throughout the course of treatment and that the effective amount of a pharmaceutical composition disclosed herein that is administered can be adjusted accordingly.

In one embodiment, a cancer therapeutic disclosed herein is capable of reducing the number of cancer cells or tumor size in an individual suffering from a cancer by, e.g., at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90% or at least 95% as compared to a patient not receiving the same treatment. In other aspects of this embodiment, a cancer therapeutic is capable of reducing the number of cancer cells or tumor size in an individual suffering from a cancer by, e.g., about 10% to about 100%, about 20% to about 100%, about 30% to about 100%, about 40% to about 100%, about 50% to about 100%, about 60% to about 100%, about 70% to about 100%, about 80% to about 100%, about 10% to about 90%, about 20% to about 90%, about 30% to about 90%, about 40% to about 90%, about 50% to about 90%, about 60% to about 90%, about 70% to about 90%, about 10% to about 80%, about 20% to about 80%, about 30% to about 80%, about 40% to about 80%, about 50% to about 80%, or about 60% to about 80%, about 10% to about 70%, about 20% to about 70%, about 30% to about 70%, about 40% to about 70%, or about 50% to about 70% as compared to a patient not receiving the same treatment.

In a further embodiment, a cancer therapeutic and its derivatives have half-lives of 2 hours, 3 hours, 4 hours, 5 hours, 6 hours, 7 hours, 8 hours, 9 hours, 10 hours, 11 hours, 12 hours, 13 hours, 14 hours, 15 hours, 16 hours, 17 hours, 18 hours, 19 hours, 20 hours, 21 hours, 22 hours, 23 hours, 1 day, 2 days, 3 days, 4 days, 5 days, 6 days, 7 days, 1 week, 2 weeks, 3 weeks, 4 weeks, one month, two months, three months, four months or more.

In an embodiment, the period of administration of a cancer therapeutic is for 1 day, 2 days, 3 days, 4 days, 5 days, 6 days, 7 days, 8 days, 9 days, 10 days, 11 days, 12 days, 13 days, 14 days, 3 weeks, 4 weeks, 5 weeks, 6 weeks, 7 weeks, 8 weeks, 9 weeks, 10 weeks, 11 weeks, 12 weeks, 4 months, 5 months, 6 months, 7 months, 8 months, 9 months, 10 months, 11 months, 12 months, or more. In a further embodiment, a period of during which administration is stopped is for 1 day, 2 days, 3 days, 4 days, 5 days, 6 days, 7 days, 8 days, 9 days, 10 days, 11 days, 12 days, 13 days, 14 days, 3 weeks, 4 weeks, 5 weeks, 6 weeks, 7 weeks, 8 weeks, 9 weeks, 10 weeks, 11 weeks, 12 weeks, 4 months, 5 months, 6 months, 7 months, 8 months, 9 months, 10 months, 11 months, 12 months, or more.

In aspects of this embodiment, a therapeutically effective amount of a cancer therapeutic disclosed herein reduces or maintains a cancer cell population and/or tumor cell size in an individual by, e.g., at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95% or at least 100%. In other aspects of this embodiment, a therapeutically effective amount of a cancer therapeutic disclosed herein reduces or maintains a cancer cell population and/or tumor cell size in an individual by, e.g., at most 10%, at most 15%, at most 20%, at most 25%, at most 30%, at most 35%, at most 40%, at most 45%, at most 50%, at most 55%, at most 60%, at most 65%, at most 70%, at most 75%, at most 80%, at most 85%, at most 90%, at most 95% or at most 100%. In yet other aspects of this embodiment, a therapeutically effective amount of a cancer therapeutic disclosed herein reduces or maintains a cancer cell population and/or tumor cell size in an individual by, e.g., about 10% to about 100%, about 10% to about 90%, about 10% to about 80%, about 10% to about 70%, about 10% to about 60%, about 10% to about 50%, about 10% to about 40%, about 20% to about 100%, about 20% to about 90%, about 20% to about 80%, about 20% to about 20%, about 20% to about 60%, about 20% to about 50%, about 20% to about 40%, about 30% to about 100%, about 30% to about 90%, about 30% to about 80%, about 30% to about 70%, about 30% to about 60%, or about 30% to about 50%.

A pharmaceutical composition or cancer therapeutic is administered to an individual. An individual is typically a human being, but can be an animal, including, but not limited to, dogs, cats, birds, cattle, horses, sheep, goats, reptiles and other animals, whether domesticated or not. Typically, any individual who is a candidate for treatment is a candidate with some form of cancer, whether the cancer is benign or malignant, a tumor, solid or otherwise, a cancer call not located in a tumor or some other form of cancer. Among the most common types of cancer include, but are not limited to, bladder cancer, breast cancer, colon and rectal cancer, endometrial cancer, kidney cancer, renal cancer, leukemia, lung cancer, melanoma, non-Hodgkins lymphoma, pancreatic cancer, prostate cancer, stomach cancer and thyroid cancer. Pre-operative evaluation typically includes routine history and physical examination in addition to thorough informed consent disclosing all relevant risks and benefits of the procedure.

In one aspect, a pharmaceutical composition disclosed herein reduces a symptom of a disorder associated with a cancer. In aspects of this embodiment, a pharmaceutical composition disclosed herein reduces a symptom of a disorder associated with a cancer by, e.g., at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90% or at least 95%. In other aspects of this embodiment, a pharmaceutical composition disclosed herein reduces a symptom of a disorder associated with a cancer by, e.g., about 10% to about 100%, about 20% to about 100%, about 30% to about 100%, about 40% to about 100%, about 50% to about 100%, about 60% to about 100%, about 70% to about 100%, about 80% to about 100%, about 10% to about 90%, about 20% to about 90%, about 30% to about 90%, about 40% to about 90%, about 50% to about 90%, about 60% to about 90%, about 70% to about 90%, about 10% to about 80%, about 20% to about 80%, about 30% to about 80%, about 40% to about 80%, about 50% to about 80%, or about 60% to about 80%, about 10% to about 70%, about 20% to about 70%, about 30% to about 70%, about 40% to about 70%, or about 50% to about 70%.

In another aspect, a pharmaceutical composition disclosed herein reduces the frequency of a symptom of a disorder associated with a cancer incurred over a given time period. In aspects of this embodiment, a pharmaceutical composition disclosed herein reduces the frequency of a symptom of a disorder associated with a cancer incurred over a given time period by, e.g., at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90% or at least 95%. In other aspects of this embodiment, a pharmaceutical composition disclosed herein reduces the frequency of a symptom of a disorder associated with a cancer incurred over a given time period by, e.g., about 10% to about 100%, about 20% to about 100%, about 30% to about 100%, about 40% to about 100%, about 50% to about 100%, about 60% to about 100%, about 70% to about 100%, about 80% to about 100%, about 10% to about 90%, about 20% to about 90%, about 30% to about 90%, about 40% to about 90%, about 50% to about 90%, about 60% to about 90%, about 70% to about 90%, about 10% to about 80%, about 20% to about 80%, about 30% to about 80%, about 40% to about 80%, about 50% to about 80%, or about 60% to about 80%, about 10% to about 70%, about 20% to about 70%, about 30% to about 70%, about 40% to about 70%, or about 50% to about 70%.

TABLE 1

DLL3 HC and LC Pairs

| Full ab name | VH Seq ID | VL seq ID | HCDR1 Seq ID | HCDR2 Seq ID | HDCR3 Seq ID | LCDR1 Seq ID | LCDR2 Seq ID | LCDR3 Seq ID |
|---|---|---|---|---|---|---|---|---|
| DLL3.3 | 72 | 76 | 7 | 14 | 27 | 31 | 40 | 47 |
| DLL3.4 | 73 | 77 | 1 | 11 | 22 | 32 | 39 | 54 |
| DLL3.26 | 58 | 78 | 6 | 16 | 24 | 33 | 43 | 49 |
| DLL3.27 | 65 | 78 | 5 | 16 | 24 | 33 | 43 | 49 |
| DLL3.1 | 71 | 79 | 2 | 10 | 22 | 32 | 46 | 55 |
| DLL3.2 | 73 | 79 | 1 | 11 | 22 | 32 | 46 | 55 |
| DLL3.8 | 67 | 80 | 4 | 12 | 23 | 36 | 44 | 48 |
| DLL3.9 | 64 | 81 | 3 | 13 | 28 | 32 | 46 | 54 |
| DLL3.22 | 57 | 82 | 6 | 15 | 25 | 33 | 43 | 51 |
| DLL3.23 | 59 | 82 | 6 | 16 | 25 | 33 | 43 | 51 |
| DLL3.24 | 61 | 82 | 6 | 18 | 25 | 33 | 43 | 51 |
| DLL3.25 | 63 | 82 | 6 | 16 | 25 | 33 | 43 | 51 |
| DLL3.15 | 56 | 83 | 6 | 15 | 24 | 34 | 43 | 49 |
| DLL3.5 | 58 | 83 | 6 | 16 | 24 | 34 | 43 | 49 |
| DLL3.16 | 60 | 83 | 6 | 18 | 24 | 34 | 43 | 49 |
| DLL3.17 | 62 | 83 | 6 | 16 | 24 | 34 | 43 | 49 |
| DLL3.18 | 57 | 84 | 6 | 15 | 25 | 37 | 42 | 51 |
| DLL3.19 | 59 | 84 | 6 | 16 | 25 | 37 | 42 | 51 |
| DLL3.20 | 61 | 84 | 6 | 18 | 25 | 37 | 42 | 51 |
| DLL3.21 | 63 | 84 | 6 | 16 | 25 | 37 | 42 | 51 |
| DLL3.11 | 56 | 85 | 7 | 15 | 24 | 38 | 42 | 49 |
| DLL3.12 | 58 | 85 | 6 | 16 | 24 | 38 | 42 | 49 |
| DLL3.13 | 60 | 85 | 6 | 18 | 24 | 38 | 42 | 49 |
| DLL3.14 | 62 | 85 | 6 | 16 | 24 | 38 | 42 | 49 |

TABLE 1-continued

DLL3 HC and LC Pairs

| Full ab name | VH Seq ID | VL seq ID | HCDR1 Seq ID | HCDR2 Seq ID | HDCR3 Seq ID | LCDR1 Seq ID | LCDR2 Seq ID | LCDR3 Seq ID |
|---|---|---|---|---|---|---|---|---|
| DLL3.32 | 70 | 86 | 5 | 16 | 25 | 33 | 43 | 51 |
| DLL3.33 | 70 | 86 | 5 | 16 | 25 | 33 | 43 | 51 |
| DLL3.10 | 69 | 87 | 5 | 16 | 24 | 34 | 43 | 49 |
| DLL3.31 | 69 | 87 | 5 | 16 | 24 | 34 | 43 | 49 |
| DLL3.29 | 68 | 88 | 5 | 17 | 26 | 34 | 43 | 50 |
| DLL3.30 | 68 | 88 | 5 | 17 | 26 | 34 | 43 | 50 |
| DLL3.36 | 68 | 88 | 5 | 17 | 26 | 34 | 43 | 50 |
| DLL3.34 | 74 | 89 | 8 | 19 | 23 | 35 | 45 | 52 |
| DLL3.28 | 66 | 90 | 9 | 21 | 29 | 32 | 39 | 54 |

TABLE 2

DLL3-CD3

| format | Molecule Name | Seq ID chain1 | seq ID chain2 | seq ID chain3 |
|---|---|---|---|---|
| DLL3-scFvxCD3-scFv | 3D34C | 341 | 239 | — |
| DLL3-scFvxCD3-scFv | 3D35C | 342 | 239 | — |
| DLL3-scFvxCD3-scFv | 3D36C | 346 | 239 | — |
| DLL3-scFvxCD3-scFv | 3D36D | 343 | 239 | — |
| DLL3-scFvxCD3-scFv | 3D36I | 347 | 239 | — |
| DLL3-scFvxCD3-scFv | 3D36K | 348 | 239 | — |
| DLL3-scFvxCD3-scFv | 3D37C | 345 | 239 | — |
| DLL3-scFvxCD3-scFv | 3D44I | 344 | 239 | — |
| DLL3-Fab/CD3-scFv | 3D1 | 273 | 290 | 298 |
| DLL3-Fab/CD3-scFv | 3D10 | 273 | 292 | 296 |
| DLL3-Fab/CD3-scFv | 3D10B | 262 | 292 | 296 |
| DLL3-Fab/CD3-scFv | 3D10C | 263 | 292 | 296 |
| DLL3-Fab/CD3-scFv | 3D11B | 262 | 286 | 310 |
| DLL3-Fab/CD3-scFv | 3D11C | 263 | 286 | 310 |
| DLL3-Fab/CD3-scFv | 3D12B | 262 | 288 | 308 |
| DLL3-Fab/CD3-scFv | 3D12C | 263 | 288 | 308 |
| DLL3-Fab/CD3-scFv | 3D13B | 262 | 289 | 306 |
| DLL3-scFvxCD3-scFv/DLL3-Fab | 3D34-22C | 341 | 276 | 302 |
| DLL3-scFvxCD3-scFv/DLL3-Fab | 3D35-22C | 342 | 276 | 302 |
| DLL3-scFvxCD3-scFv/DLL3-Fab | 3D36-22C | 346 | 276 | 302 |
| DLL3-scFvxCD3-scFv/DLL3-Fab | 3D37-22C | 345 | 276 | 302 |
| DLL3-Fab/CD3-scFv | 3D13C | 263 | 289 | 306 |
| DLL3-scFvxCD3-scFv/DLL3-Fab | 3D45I | 347 | 276 | 297 |
| DLL3-Fab/CD3-scFv | 3D14B | 262 | 284 | 312 |
| DLL3-Fab/CD3-scFv | 3D14C | 263 | 284 | 312 |
| DLL3-Fab/CD3-scFv | 3D15C | 263 | 287 | 309 |
| DLL3-Fab/CD3-scFv | 3D16C | 263 | 288 | 307 |
| DLL3-Fab/CD3-scFv | 3D17C | 263 | 289 | 305 |
| DLL3-Fab/CD3-scFv | 3D18C | 263 | 276 | 304 |
| DLL3-Fab/CD3-scFv | 3D19C | 263 | 274 | 304 |
| DLL3-Fab/CD3-scFv | 3D1B | 262 | 290 | 298 |
| DLL3-Fab/CD3-scFv | 3D1C | 263 | 290 | 298 |
| DLL3-Fab/CD3-scFv | 3D1I | 269 | 290 | 298 |
| DLL3-Fab/CD3-scFv | 3D20C | 263 | 278 | 304 |
| DLL3-Fab/CD3-scFv | 3D21C | 263 | 280 | 304 |
| DLL3-scFvxCD3-scFv-Fc-Fc | 3DBM | Benchmark CD3xDLL3 | | |
| DLL3-Fab/CD3-scFv | 3D22C | 263 | 276 | 302 |
| DLL3-Fab/CD3-scFv | 3D22D | 264 | 276 | 302 |
| DLL3-Fab/CD3-scFv | 3D22I | 269 | 276 | 302 |
| DLL3-Fab/CD3-scFv | 3D22K | 271 | 276 | 302 |
| DLL3-Fab/CD3-scFv | 3D23C | 263 | 274 | 302 |
| DLL3-Fab/CD3-scFv | 3D24C | 263 | 278 | 302 |
| DLL3-Fab/CD3-scFv | 3D25C | 263 | 280 | 302 |
| DLL3-Fab/CD3-scFv | 3D26C | 263 | 277 | 303 |
| DLL3-Fab/CD3-scFv | 3D27C | 263 | 275 | 303 |
| DLL3-scFvxCD3-scFv/DLL3-Fab | 3D34-16C | 341 | 288 | 307 |

TABLE 2-continued

DLL3-CD3

| format | Molecule Name | Seq ID chain1 | seq ID chain2 | seq ID chain3 |
|---|---|---|---|---|
| DLL3-scFvxCD3-scFv/DLL3-Fab | 3D35-16C | 342 | 288 | 307 |
| DLL3-scFvxCD3-scFv/DLL3-Fab | 3D36-16C | 346 | 288 | 307 |
| DLL3-scFvxCD3-scFv/DLL3-Fab | 3D37-16C | 345 | 288 | 307 |
| DLL3-Fab/CD3-scFv | 3D28C | 263 | 279 | 303 |
| DLL3-Fab/CD3-scFv | 3D29C | 263 | 281 | 303 |
| DLL3-Fab/CD3-scFv | 3D30C | 263 | 277 | 301 |
| DLL3-Fab/CD3-scFv | 3D31C | 263 | 275 | 301 |
| DLL3-Fab/CD3-scFv | 3D32C | 263 | 279 | 301 |
| DLL3-Fab/CD3-scFv | 3D33C | 263 | 281 | 301 |
| DLL3-Fab/CD3-scFv | 3D38I | 269 | 283 | 297 |
| DLL3-scFvxCD3-scFv/DLL3-Fab | 3D34-1C | 341 | 290 | 298 |
| DLL3-scFvxCD3-scFv/DLL3-Fab | 3D35-1C | 342 | 290 | 298 |
| DLL3-scFvxCD3-scFv/DLL3-Fab | 3D36-1C | 346 | 290 | 298 |
| DLL3-scFvxCD3-scFv/DLL3-Fab | 3D37-1C | 345 | 290 | 298 |
| DLL3-Fab/CD3-scFv | 3D39I | 269 | 276 | 297 |
| DLL3-Fab/CD3-scFv | 3D4 | 273 | 291 | 295 |
| DLL3-Fab/CD3-scFv | 3D40I | 269 | 285 | 299 |
| DLL3-Fab/CD3-scFv | 3D41I | 269 | 282 | 300 |
| DLL3-Fab/CD3-scFv | 3D42I | 269 | 294 | 313 |
| DLL3-Fab/CD3-scFv | 3D43I | 269 | 293 | 311 |
| DLL3-Fab/CD3-scFv | 3D4B | 262 | 291 | 295 |
| DLL3-Fab/CD3-scFv | 3D4C | 263 | 291 | 295 |
| DLL3-Fab/CD3-scFv | 3D4D | 264 | 291 | 295 |
| DLL3-Fab/CD3-scFv | 3D4E | 265 | 291 | 295 |
| DLL3-Fab/CD3-scFv | 3D4F | 266 | 291 | 295 |
| DLL3-Fab/CD3-scFv | 3D4G | 267 | 291 | 295 |
| DLL3-scFvxCD3-scFv/DLL3-Fab | 3D34-4C | 341 | 291 | 295 |
| DLL3-scFvxCD3-scFv/DLL3-Fab | 3D35-4C | 342 | 291 | 295 |
| DLL3-scFvxCD3-scFv/DLL3-Fab | 3D36-4C | 346 | 291 | 295 |
| DLL3-scFvxCD3-scFv/DLL3-Fab | 3D37-4C | 345 | 291 | 295 |
| DLL3-Fab/CD3-scFv | 3D4H | 268 | 291 | 295 |
| DLL3-Fab/CD3-scFv | 3D4I | 269 | 291 | 295 |
| DLL3-Fab/CD3-scFv | 3D4J | 270 | 291 | 295 |
| DLL3-Fab/CD3-scFv | 3D4K | 271 | 291 | 295 |
| DLL3-Fab/CD3-scFv | 3D4L | 272 | 291 | 295 |
| DLL3-Fab/CD3-scFv | 3D7 | 273 | 292 | 298 |
| DLL3-scFvxCD3-scFv/DLL3-Fab | 3D34-7C | 341 | 292 | 298 |

TABLE 3

DLL3-CD28

| format | Molecule Name | Seq ID chain 1 | Seq Id chain 2 | seq id chain 3 |
|---|---|---|---|---|
| CD28-Fab/DLL3-scFv | 28D1 | 425 | 426 | 431 |
| CD28-Fab/DLL3-scFv | 28D2 | 425 | 426 | 434 |
| CD28-Fab/DLL3-scFv | 28D3 | 425 | 426 | 432 |
| CD28-Fab/DLL3-scFv | 28D4 | 425 | 426 | 433 |
| CD28-scFv/DLL3-Fab | 28D9 | 427 | 290 | 298 |
| CD28-scFv/DLL3-Fab | 28D10 | 427 | 291 | 295 |
| CD28-scFv/DLL3-Fab | 28D11 | 427 | 292 | 298 |
| CD28-scFv/DLL3-Fab | 28D12 | 427 | 292 | 296 |
| CD28-scFv/DLL3-Fab | 28D13 | 428 | 291 | 295 |
| CD28-scFv/DLL3-Fab | 28D14 | 429 | 291 | 295 |
| CD28-scFv/DLL3-Fab | 28D15 | 430 | 291 | 295 |
| CD28-scFv/DLL3-Fab | 28D16 | 430 | 292 | 296 |
| CD28-scFv/DLL3-Fab | 28D17 | 430 | 276 | 302 |
| CD28-scFv/DLL3-Fab | 28D18 | 430 | 290 | 298 |

TABLE 3-continued

DLL3-CD28

| format | Molecule Name | Seq ID chain 1 | Seq Id chain 2 | seq id chain 3 |
|---|---|---|---|---|
| CD28-scFv/DLL3-Fab | 28D19 | 430 | 276 | 297 |

TABLE 4

DLL4-41 BB

| format | Molecule Name | Seq ID chain1 | seq ID chain2 | seq Id chain3 |
|---|---|---|---|---|
| 4-1BB-Fab/DLL3-scFv | 4D1 | 437 | 438 | 431 |
| 4-1BB-Fab/DLL3-scFv | 4D2 | 437 | 438 | 434 |
| 4-1BB-Fab/DLL3-scFv | 4D3 | 437 | 438 | 432 |
| 4-1BB-Fab/DLL3-scFv | 4D4 | 437 | 438 | 433 |
| 4-1BB-scFv/DLL3-Fab | 4D5 | 441 | 291 | 295 |
| 4-1BB-scFv/DLL3-Fab | 4D6 | 442 | 291 | 295 |
| 4-1BB-scFv/DLL3-Fab | 4D7 | 445 | 291 | 295 |
| 4-1BB-Fab/DLL3-scFv | 4D8 | 437 | 438 | 466 |
| 4-1BB-Fab/DLL3-scFv | 4D9 | 437 | 438 | 467 |
| 4-1BB-scFv/DLL3-Fab | 4D10 | 446 | 291 | 295 |
| 4-1BB-scFv/DLL3-Fab | 4D11 | 447 | 291 | 295 |
| 4-1BB-scFv/DLL3-Fab | 4D12 | 448 | 291 | 295 |
| 4-1BB-scFv/DLL3-Fab | 4D13 | 444 | 291 | 295 |
| 4-1BB-scFv/DLL3-Fab | 4D14 | 443 | 290 | 298 |
| DLL3-scFv/4-1BB-Fab | 4D15 | 432 | 439 | 440 |
| DLL3scFv-41BBscFv-fc X 41BBscFv-fc | 4D16 | 468 | 439 | 440 |
| 4-1BBscFv-41BBscFv-Fc x DLL3Fab-Fe | 4D17 | 469 | 291 | 295 |
| 41BBFab-Fe-DLL3scFv | 4D18 | 470 | 472 | 440 |
| 41BBFab-Fe-DLL3scFv | 4D19 | 471 | 473 | 298 |

TABLE 5

DLL3 x CD3 x CD28

| format | Molecule Name | Seq Id chain 1 | seq ID Chain 2 | Seq ID chain 3 |
|---|---|---|---|---|
| CD28scFvxCD3scFv/DLL3-Fab | 328D1 | 481 | 276 | 302 |
| CD28scFvxCD3scFv/DLL3-Fab | 328D2 | 481 | 291 | 295 |
| CD28scFvxCD3scFv/DLL3-Fab | 328D3 | 481 | 290 | 298 |
| CD28scFvxCD3scFv/DLL3-Fab | 328D4 | 481 | 276 | 297 |
| DLL3scFvxCD3scFv/CD28-Fab | 328D5 | 343 | 425 | 426 |

TABLE 6

DLL3 x CD3 x CD137

| format | Molecule Name | Seq ID chain 1 | Seq ID Chain2 | Seq Id chain 3 |
|---|---|---|---|---|
| DLL3-scFvxCD3scFv/4-1BB-Fab | 34D1 | 343 | 437 | 438 |
| DLL3-scFvxCD3scFv/4-1BB-Fab | 34D2 | 341 | 437 | 438 |
| DLL3-scFvxCD3scFv/4-1BB-Fab | 34D3 | 342 | 437 | 438 |
| DLL3-scFvxCD3scFv/4-1BB-Fab | 34D4 | 343 | 437 | 438 |
| DLL3-scFvxCD3scFv/4-1BB-Fab | 34D5 | 346 | 439 | 440 |
| DLL3-scFvxCD3scFv/4-1BB-Fab | 34D6 | 341 | 439 | 440 |
| DLL3-scFvxCD3scFv/4-1BB-Fab | 34D7 | 342 | 439 | 440 |
| DLL3-scFvxCD3scFv/4-1BB-Fab | 34D8 | 343 | 439 | 440 |
| 4-1BBFab-Fc-CD3scFv x 4-1BBFab-Fc-DLL3scFv | 34D9 | 487 | 471 | 438 |
| 4-1BB-FabxFcxCD3scFvxDLL3-scFv/4-1BB-Fab | 34D10 | 494 | 437 | 438 |
| 4-1BB-FabxFcxCD3scFv/4-1BB-FabxFcxDLL3-scFv | 34D11 | 495 | 472 | 440 |
| 4-1BB-FabxFcxCD3scFvxDLL3-scFv/4-1BB-Fab | 34D12 | 496 | 496 | 440 |
| CD3-scFvxFcx4-1BB-scFv/DLL3-Fab-Fc-4-1BBscFv | 34D13 | 486 | 498 | 295 |
| CD3-scFv x DLL3Fab-Fc-4-1BBscFv-4-1BB-scFv | 34D14 | 269 | 499 | 295 |
| DLL3scFv-CD3scFv-Fc-4-1BBscFv x Fc-4-1BBscFv | 34D15 | 497 | 488 | — |
| DLL3-scFvxCD3scFv/Fcx4-1BB-scFvx4-1BB-scFv | 34D16 | 346 | 489 | — |

TABLE 7

MUC17 VH and VL pairs

| AB Name | VH Seq ID | VL Seq ID | HCDR1 Seq ID | HCDR2 Seq ID | HCDR3 Seq ID | LCDR1 Seq ID | LCDR2 Seq ID | LCDR3 SeqID |
|---|---|---|---|---|---|---|---|---|
| Muc17.7 | 146 | 149 | 92 | 106 | 111 | 118 | 121 | 124 |
| Muc17.21 | 146 | 148 | 92 | 106 | 111 | 118 | 121 | 124 |
| Muc17.22 | 146 | 150 | 92 | 106 | 111 | 118 | 121 | 124 |
| Muc17.23 | 146 | 169 | 92 | 106 | 111 | 118 | 121 | 124 |
| Muc17.24 | 146 | 147 | 92 | 106 | 111 | 118 | 121 | 126 |
| Muc17.2 | 139 | 154 | 93 | 105 | 108 | 116 | 119 | 123 |
| Muc17.1 | 127 | 166 | 94 | 103 | 108 | 116 | 119 | 122 |
| Muc17.10 | 127 | 164 | 94 | 103 | 108 | 116 | 119 | 122 |
| Muc17.11 | 127 | 162 | 94 | 103 | 108 | 116 | 119 | 122 |
| muc17.12 | 127 | 165 | 94 | 103 | 108 | 116 | 119 | 122 |
| Muc17.13 | 127 | 161 | 94 | 103 | 108 | 116 | 119 | 122 |
| Muc17.14 | 127 | 160 | 94 | 103 | 108 | 116 | 119 | 122 |

TABLE 7-continued

MUC17 VH and VL pairs

| AB Name | VH Seq ID | VL Seq ID | HCDR1 Seq ID | HCDR2 Seq ID | HDCR3 Seq ID | LCDR1 Seq ID | LCDR2 Seq ID | LCDR3 SeqID |
|---|---|---|---|---|---|---|---|---|
| Muc17.25 | 140 | 163 | 94 | 103 | 108 | 116 | 119 | 122 |
| Muc17.26 | 140 | 160 | 94 | 103 | 108 | 116 | 119 | 122 |
| Muc17.27 | 140 | 153 | 94 | 103 | 108 | 116 | 119 | 122 |
| Muc17.28 | 140 | 155 | 94 | 103 | 108 | 116 | 119 | 122 |
| Muc17.29 | 129 | 163 | 94 | 103 | 108 | 116 | 119 | 122 |
| Muc17.30 | 129 | 160 | 94 | 103 | 108 | 116 | 119 | 127 |
| Muc17.31 | 129 | 153 | 94 | 103 | 108 | 116 | 119 | 122 |
| Muc17.8 | 127 | 153 | 94 | 107 | 108 | 116 | 119 | 122 |
| Muc17.9 | 127 | 163 | 94 | 103 | 108 | 116 | 119 | 122 |
| Muc17.3 | 141 | 156 | 95 | 104 | 112 | 117 | 120 | 123 |
| Muc17.15 | 145 | 159 | 97 | 101 | 109 | 115| | 119 | 125 |
| Muc17.16 | 145 | 152 | 97 | 101 | 109 | 115 | 119 | 125 |
| Muc17.17 | 128 | 152 | 96 | 99 | 109 | 115 | 119 | 125 |
| Muc17.18 | 145 | 151 | 97 | 101 | 109 | 114 | 119 | 125 |
| Muc17.19 | 145 | 167 | 97 | 101 | 109 | 114 | 119 | 125 |
| Muc17.31 | 136 | 168 | 98 | 101 | 109 | 115 | 119 | 125 |
| Muc17.32 | 135 | 168 | 97 | 101 | 109 | 115 | 119 | 125 |
| Muc17.33 | 135 | 159 | 97 | 101 | 109 | 115 | 119 | 125 |
| Muc17.34 | 135 | 152 | 97 | 101 | 109 | 115 | 119 | 125 |
| Muc17.35 | 133 | 168 | 97 | 101 | 109 | 115 | 119 | 125 |
| Muc17.20 | 131 | 157 | 97 | 100 | 110 | 115 | 119 | 125 |
| Muc17.36 | 134 | 168 | 97 | 101 | 109 | 115 | 119 | 125 |
| Muc17.37 | 132 | 168 | 97 | 101 | 109 | 115 | 119 | 125 |
| Muc17.38 | 137 | 168 | 97 | 101 | 109 | 115 | 119 | 125 |
| Muc17.39 | 144 | 152 | 97 | 99 | 109 | 115 | 119 | 125 |
| Muc17.4 | 145 | 168 | 97 | 101 | 109 | 115 | 119 | 125 |
| Muc17.40 | 144 | 168 | 97 | 99 | 109 | 115 | 119 | 125 |
| Muc17.41 | 144 | 167 | 97 | 99 | 109 | 114 | 119 | 125 |
| Muc17.42 | 143 | 152 | 96 | 101 | 109 | 115 | 119 | 125 |
| Muc17.43 | 143 | 168 | 96 | 101 | 109 | 115 | 119 | 125 |
| Muc17.44 | 143 | 167 | 96 | 101 | 109 | 114 | 119 | 125 |
| Muc17.45 | 130 | 159 | 97 | 101 | 109 | 115 | 119 | 125 |
| Muc17.46 | 142 | 167 | 96 | 99 | 109 | 114 | 119 | 125 |
| Muc17.47 | 142 | 168 | 96 | 99 | 109 | 115 | 119 | 125 |
| Muc17.48 | 136 | 159 | 97 | 101 | 109 | 115 | 119 | 125 |
| Muc17.5 | 131 | 159 | 97 | 100 | 110 | 115 | 119 | 125 |
| Muc17.49 | 136 | 152 | 97 | 101 | 109 | 115 | 119 | 125 |

TABLE 8

MUC17 VH × CD3

| format | Molecule Name | SEQID Chain1 | SEQID Chain2 | SEQ ID Chain3 |
|---|---|---|---|---|
| Muc17-Fab/CD3-scFv | 3M23C | 263 | 379 | 387 |
| Muc17-Fab/CD3-scFv | 3M24C | 263 | 379 | 388 |
| Muc17-Fab/CD3-scFv | 3M25C | 263 | 372 | 390 |
| Muc17-Fab/CD3-scFv | 3M26C | 263 | 372 | 389 |
| Muc17-Fab/CD3-scFv | 3M27C | 263 | 377 | 390 |
| Muc17-Fab/CD3-scFv | 3M28C | 263 | 371 | 390 |
| Muc17-Fab/CD3-scFv | 3M29C | 263 | 368 | 382 |
| Muc17-scFvxCD3-scFv-scfc | 3M2C2 | 352 | | |
| Muc17-Fab/CD3-scFv | 3M30C | 263 | 368 | 383 |
| Muc17-Fab/CD3-scFv | 3M31C | 263 | 368 | 385 |
| Muc17-Fab/CD3-scFv | 3M32C | 263 | 368 | 384 |
| Muc17-Fab/CD3-scFv | 3M33C | 263 | 368 | 381 |
| Muc17-Fab/CD3-scFv | 3M34C | 263 | 370 | 394 |
| Muc17-Fab/CD3-scFv | 3M35C | 263 | 370 | 391 |
| Muc17-Fab/CD3-scFv | 3M36C | 263 | 370 | 387 |
| Muc17-Fab/CD3-scFv | 3M37C | 263 | 369 | 394 |
| Muc17-Fab/CD3-scFv | 3M38C | 263 | 369 | 391 |
| Muc17-Fab/CD3-scFv | 3M39C | 263 | 369 | 387 |
| Muc17-Fab/CD3-scFv | 3M40C | 263 | 379 | 394 |
| Muc17-Fab/CD3-scFv | 3M41C | 263 | 379 | 391 |
| Muc17-Fab/CD3-scFv | 3M42C | 263 | 379 | 387 |
| Muc17-Fab/CD3-scFv | 3M43C | 263 | 376 | 399 |
| Muc17-Fab/CD3-scFv | 3M44C | 263 | 376 | 386 |
| Muc17-Fab/CD3-scFv | 3M45C | 263 | 376 | 390 |
| Muc17-Fab/CD3-scFv | 3M46C | 263 | 380 | 399 |
| Muc17-Fab/CD3-scFv | 3M47C | 263 | 380 | 386 |

TABLE 8-continued

MUC17 VH × CD3

| format | Molecule Name | SEQID Chain1 | SEQID Chain2 | SEQ ID Chain3 |
|---|---|---|---|---|
| Muc17-Fab/CD3-scFv | 3M48C | 263 | 380 | 390 |
| Muc17-Fab/CD3-scFv | 3M49C | 263 | 377 | 399 |
| Muc17-Fab/CD3-scFv | 3M50C | 263 | 377 | 386 |
| Muc17-Fab/CD3-scFv | 3M51C | 263 | 377 | 390 |
| Muc17-Fab/CD3-scFv | 3M52C | 263 | 369 | 397 |
| Muc17-Fab/CD3-scFv | 3M53C | 263 | 369 | 392 |
| Muc17-Fab/CD3-scFv | 3M54C | 263 | 369 | 396 |
| Muc17-Fab/CD3-scFv | 3M55C | 263 | 369 | 398 |
| Muc17-scFv/CD3-Fab | 3M55D | 264 | 369 | 400 |
| Muc17-scFv/CD3-Fab | 3M55I | 269 | 369 | 400 |
| Muc17-scFv/CD3-Fab | 3M55K | 271 | 369 | 400 |
| Muc17-Fab/CD3-scFv | 3M56C | 263 | 374 | 399 |
| Muc17-Fab/CD3-scFv | 3M57C | 263 | 375 | 399 |
| Muc17-Fab/CD3-scFv | 3M58C | 263 | 373 | 399 |
| Muc17-Fab/CD3-scFv | 3M59C | 263 | 378 | 399 |
| Muc17-Fab/CD3-scFv | 3M60C | 263 | 369 | 393 |
| Muc17-scFvxCD3-scFv | 3M61C | 350 | 239 | |
| Muc17-scFvxCD3-scFv | 3M62C | 363 | 239 | |
| Muc17-scFvxCD3-scFv | 3M62D | 362 | 239 | |
| Muc17-scFvxCD3-scFv | 3M62I | 364 | 239 | |
| Muc17-scFvxCD3-scFv | 3M62K | 365 | 239 | |
| Muc17-scFvxCD3-scFv/Muc17-Fab | 3M63C | 350 | 380 | 399 |
| Muc17-scFvxCD3-scFv/Muc17-Fab | 3M64C | 363 | 369 | 398 |
| Muc17-scFv/CD3-Fab | 3M65C | 366 | 263 | 400 |
| Muc17-scFv/CD3-Fab | 3M66C | 367 | 263 | 400 |
| Muc17-scFvxCD3-scFv | 3M67I | 349 | 239 | |
| Muc17-scFvxCD3-scFv | 3M68I | 354 | 239 | |
| Muc17-scFvxCD3-scFv-scfc | 3M8B7 | 351 | | |
| 1MU32scFv-CD3scFv-Fe | | 361 | 239 | |
| 1MU8AscFv-CD3scFv-Fe | | 353 | 239 | |
| 1MU32scFv(Y32F)-CD3scFv-Fe | | 360 | 239 | |
| 1MU32scFv(M34L)-CD3scFv-Fe | | 357 | 239 | |
| 1 MU32scFv(T58S)-CD3scFv-Fe | | 359 | 239 | |

TABLE 9

MUC17 × CD28

| format | Molecule Name | SeqID Chain1 | SeqID Chain2 | SeqID Chain3 |
|---|---|---|---|---|
| Muc17-Fab/CD28-scFv | 28M1 | 427 | 368 | 384 |
| Muc17-Fab/CD28-scFv | 28M2 | 427 | 380 | 399 |
| Muc17-Fab/CD28-scFv | 28M3 | 427 | 369 | 398 |
| Muc17-Fab/CD28-scFv | 28M4 | 430 | 368 | 384 |
| Muc17-Fab/CD28-scFv | 28M5 | 430 | 380 | 399 |
| Muc17-Fab/CD28-scFv | 28M6 | 430 | 369 | 398 |

TABLE 10

MUC17 × 4188

| format | Molecule Name | Seq ID chain1 | seq ID chain2 | seq Id chain3 |
|---|---|---|---|---|
| Muc17-scfv/4-1BB-Fab | 4M1 | 366 | 437 | 438 |
| Muc17-scfv/4-1BB-Fab | 4M2 | 367 | 437 | 438 |
| Muc17-scfv/4-1BB-Fab | 4M3 | 474 | 437 | 438 |
| 4-1BB-scFv/Muc17-Fab | 4M4 | 451 | 369 | 398 |
| 4-1BB-scFv/Muc17-Fab | 4M5 | 545 | 369 | 398 |
| 4-1BB-scFv/Muc17-Fab | 4M6 | 450 | 369 | 398 |
| 4-1BB-scFv/Muc17-Fab | 4M7 | 451 | 380 | 399 |
| 4-1BB-scFv/Muc17-Fab | 4M8 | 452 | 380 | 399 |
| 4-1BB-scFv/Muc17-Fab | 4M9 | 453 | 369 | 398 |
| 4-1BB-scFv/Muc17-Fab | 4M10 | 447 | 369 | 398 |
| 4-1BB-scFv/Muc17-Fab | 4M11 | 448 | 369 | 398 |
| 4-1BB-scFv/Muc17-Fab | 4M12 | 444 | 369 | 398 |
| 4-1BB-scFv/Muc17-Fab | 4M13 | 443 | 369 | 398 |
| 4-1BB-scFv/Muc17-Fab | 4M14 | 452 | 380 | 399 |
| 4-1BB-scFv/Muc17-Fab | 4M15 | 453 | 380 | 399 |

TABLE 11

MUC17 × CD3 × CD28

| format | Molecule Name | Seq Id chain 1 | seq ID Chain 2 | Seq ID chain 3 |
|---|---|---|---|---|
| CD3-scFvxCD28-scFv/Muc17-Fab | 328M1 | 480 | 369 | 398 |
| CD28-scFvxCD3-scFv/Muc17-Fab | 328M2 | 481 | 369 | 398 |
| CD28-scFvxCD3-scFv/Muc17-Fab | 328M3 | 481 | 380 | 399 |
| CD28-scFvxCD3-scFv/Muc17-Fab | 328M4 | 481 | 368 | 384 |
| Muc17-scFvxCD3-scFv/CD28-Fab | 328M5 | 362 | 482 | 483 |

TABLE 12

MUC17 × CD3 × CD137

| format | Molecule Name | Seq Id chain 1 | seq ID Chain 2 | Seq ID chain 3 |
|---|---|---|---|---|
| Muc17-scFvxCD3-scFv/4-1BB-Fab | 34M1 | 362 | 437 | 438 |
| 4-1BB-scFvxCD3-scFv/Muc17-Fab | 34M2 | 486 | 380 | 399 |
| 4-1BB-scFvxCD3-scFv/Muc17-Fab | 34M3 | 484 | 380 | 399 |
| Muc17-scFvxCD3-scFv/4-1BB-Fab | 34M4 | 362 | 439 | 440 |

TABLE 13

CLDN18.2 VH and HL pairs

| AB Name | VH Seq ID | VL Seq ID | HCDR1 Seq ID | HCDR2 Seq ID | HDCR3 Seq ID | LCDR1 Seq ID | LCDR2 Seq ID | LCDR3 Seq ID |
|---|---|---|---|---|---|---|---|---|
| CLDN182.1 | 203 | 208 | 175 | 180 | 186 | 188 | 191 | 195 |
| CLDN182.2 | 202 | 207 | 174 | 179 | 187 | 188 | 191 | 194 |
| CLDN182.3 | 198 | 209 | 170 | 181 | 185 | 188 | 191 | 196 |
| CLDN182.7 | 198 | 207 | 170 | 181 | 185 | 188 | 191 | 196 |
| cldn18.2.4 | 201 | 212 | 173 | 176 | 182 | 190 | 191 | 193 |
| CLDN18.8 | 201 | 211 | 173 | 176 | 182 | 190 | 191 | 193 |
| CLDN182.5 | 204 | 210 | 171 | 177 | 184 | 189 | 191 | 192 |
| CLDN182.6 | 206 | 206 | 172 | 178 | 183 | 188 | 191 | 192 |
| CLDN182.9 | 206 | 213 | 172 | 178 | 183 | 188 | 191 | 192 |
| CLDN182.10 | 200 | 212 | 173 | 176 | 182 | 190 | 191 | 193 |
| CLDN182.11 | 200 | 211 | 173 | 176 | 182 | 190 | 191 | 193 |
| CLDN182.12 | 197 | 209 | 170 | 181 | 185 | 188 | 191 | 196 |
| CLDN182.13 | 197 | 207 | 170 | 181 | 185 | 188 | 191 | 196 |
| CLDN182.14 | 199 | 207 | 174 | 179 | 187 | 188 | 191 | 194 |
| CLDN182.15 | 205 | 206 | 172 | 178 | 183 | 188 | 191 | 192 |
| CLDN182.16 | 205 | 213 | 172 | 178 | 183 | 188 | 191 | 192 |

TABLE 14

CLDN18.2 × CD3

| format | Molecule Name | SEQID Chain 1 | SEQID Chain 2 | SEQID Chain 3 |
|---|---|---|---|---|
| Cldn-Fab/CD3-scFv | 3C17C | 263 | 407 | 414 |
| Cldn-Fab/CD3-scFv | 3C18C | 263 | 405 | 418 |
| Cldn-Fab/CD3-scFv | 3C19C | 263 | 405 | 417 |
| Cldn-Fab/CD3-scFv | 3C20C | 263 | 404 | 418 |
| Cldn-Fab/CD3-scFv | 3C21C | 263 | 404 | 417 |
| Cldn-Fab/CD3-scFv | 3C22C | 263 | 402 | 415 |
| Cldn-Fab/CD3-scFv | 3C23C | 263 | 402 | 411 |
| Cldn-Fab/CD3-scFv | 3C24C | 263 | 401 | 415 |
| Cldn-Fab/CD3-scFv | 3C25C | 263 | 401 | 411 |
| Cldn-Fab/CD3-scFv | 3C26C | 263 | 408 | 416 |
| Cldn-F&W/CD3-scFv | 3C27C | 263 | 406 | 413 |
| Cldn-F&W/CD3-scFv | 3C28C | 263 | 403 | 413 |
| Cldn-F&W/CD3-scFv | 3C29C | 263 | 410 | 412 |

TABLE 14-continued

CLDN18.2 × CD3

| format | Molecule Name | SEQID Chain 1 | SEQID Chain 2 | SEQID Chain 3 |
|---|---|---|---|---|
| Cldn-F&W/CD3-scFv | 3C30C | 263 | 410 | 419 |
| Cldn-F&W/CD3-scFv | 3C31C | 263 | 409 | 412 |
| Cldn-F&W/CD3-scFv | 3C32C | 263 | 409 | 419 |
| Cldn-F&W/CD3-scFv | 3C18D | 264 | 405 | 418 |
| Cldn-F&W/CD3-scFv | 3C18I | 269 | 405 | 418 |
| Cldn-F&W/CD3-scFv | 3C18K | 271 | 405 | 418 |
| Cldn-F&W/CD3-scFv | 3C22D | 264 | 402 | 415 |
| Cldn-F&W/CD3-scFv | 3C22I | 269 | 402 | 415 |
| Cldn-F&W/CD3-scFv | 3C22K | 271 | 402 | 415 |
| Cldn-F&W/CD3-scFv | 3C26D | 264 | 408 | 416 |
| Cldn-F&W/CD3-scFv | 3C26I | 269 | 408 | 416 |
| Cldn-F&W/CD3-scFv | 3C26K | 271 | 408 | 416 |
| Cldn-F&W/CD3-scFv | 3C27D | 264 | 406 | 413 |
| Cldn-F&W/CD3-scFv | 3C27I | 269 | 406 | 413 |
| Cldn-Fab/CD3-scFv | 3C27K | 271 | 406 | 413 |
| CLDN-scFvxCD3-scFv-scfc | 3CBM | | | |

TABLE 15

CLDN18.2 × CD28

| format | Molecule Name | SeqID Chain1 | SeqID Chain2 | SeqID Chain3 |
|---|---|---|---|---|
| Cldn-Fab/CD28-scFv | 28C1 | 427 | 405 | 418 |
| Cldn-Fab/CD28-scFv | 28C2 | 427 | 402 | 415 |
| Cldn-Fab/CD28-scFv | 28C3 | 427 | 408 | 416 |
| Cldn-Fab/CD28-scFv | 28C4 | 427 | 406 | 413 |
| Cldn-Fab/CD28-scFv | 28C5 | 430 | 405 | 418 |

TABLE 15-continued

CLDN18.2 × CD28

| format | Molecule Name | SeqID Chain1 | SeqID Chain2 | SeqID Chain3 |
|---|---|---|---|---|
| Cldn-Fab/CD28-scFv | 28C6 | 430 | 402 | 415 |
| Cldn-Fab/CD28-scFv | 28C7 | 430 | 408 | 416 |
| Cldn-Fab/CD28-scFv | 28C8 | 430 | 406 | 413 |
| Cldn-Fab/CD28-scFv | 28C9 | 435 | 408 | 416 |
| Cldn-Fab/CD28-scFv | 28C10 | 436 | 408 | 416 |

TABLE 16

CLDN18.2 × 4188

| format | Molecule Name | SeqID chain 1 | SeqID chain 2 | SeqID chain 3 |
|---|---|---|---|---|
| Cldn-scfv/4-1BB-Fab | 4C1 | 475 | 437 | 438 |
| Cldn-scfv/4-1BB-Fab | 4C2 | 476 | 437 | 438 |
| Cldn-scfv/4-1BB-Fab | 4C3 | 477 | 437 | 438 |
| Cldn-scfv/4-1BB-Fab | 4C4 | 478 | 437 | 438 |
| Cldn-Fab/4-1BB-scFv | 4C5 | 451 | 405 | 418 |
| Cldn-Fab/4-1BB-scFv | 4C6 | 454 | 405 | 418 |
| Cldn-Fab/4-1BB-scFv | 4C7 | 451 | 408 | 416 |
| Cldn-Fab/4-1BB-scFv | 4C8 | 459 | 408 | 416 |
| Cldn-Fab/4-1BB-scFv | 4C9 | 479 | 408 | 416 |
| Cldn-Fab/4-1BB-scFv | 4C10 | 464 | 408 | 416 |
| Cldn-Fab/4-1BB-scFv | 4C11 | 460 | 408 | 416 |
| Cldn-Fab/4-1BB-scFv | 4C12 | 463 | 408 | 416 |
| Cldn-Fab/4-1BB-scFv | 4C13 | 465 | 408 | 416 |
| Cldn-Fab/4-1BB-scFv | 4C14 | 461 | 408 | 416 |
| Cldn-Fab/4-1BB-scFv | 4C15 | 454 | 408 | 416 |
| Cldn-Fab/4-1BB-scFv | 4C16 | 457 | 408 | 416 |

TABLE 16-continued

CLDN18.2 × 4188

| format | Molecule Name | SeqID chain 1 | SeqID chain 2 | SeqID chain 3 |
|---|---|---|---|---|
| Cldn-Fab/4-1BB-scFv | 4C17 | 455 | 408 | 416 |
| Cldn-Fab/4-1BB-scFv | 4C18 | 458 | 408 | 416 |
| Cldn-Fab/4-1BB-scFv | 4C19 | 456 | 408 | 416 |

TABLE 17

CLDN18.2 × CD3 × CD28

| format | Molecule Name | Seq ID chain1 | seq ID chain2 | seq Id chain3 |
|---|---|---|---|---|
| CD3-scFvxCD28-scFv/Cldn-Fab | 328C1 | 481 | 405 | 418 |
| CD3-scFvxCD28-scFv/Cldn-Fab | 328C2 | 481 | 402 | 415 |
| CD3-scFvxCD28-scFv/Cldn-Fab | 328C3 | 481 | 408 | 416 |
| CD3-scFvxCD28-scFv/Cldn-Fab | 328C4 | 481 | 406 | 413 |

TABLE 18

CLDN18.2 × CD3 × CD137

| format | Molecule Name | Seq ID chain1 | seq ID chain2 | seq Id chain3 |
|---|---|---|---|---|
| CD3-scFvx4-1BB-scFv/Cldn-Fab | 34C1 | 491 | 405 | 418 |
| CD3-scFvx4-1BB-scFv/Cldn-Fab | 34C2 | 490 | 405 | 418 |
| 4-1BB-scFvxCD3-scFv/Cldn-Fab | 34C3 | 486 | 405 | 418 |
| 4-1BB-scFvxCD3-scFv/Cldn-Fab | 34C4 | 484 | 405 | 418 |
| Cldn-scFvxCD3-scFv/4-1BB-Fab | 34C5 | 492 | 437 | 438 |
| Cldn-scFvxCD3-scFv/4-1BB-Fab | 34C6 | 493 | 437 | 438 |
| Cldn-scFvxCD3-scFv/4-1BB-Fab | 34C7 | 492 | 439 | 440 |
| Cldn-scFvxCD3-scFv/4-1BB-Fab | 34C8 | 493 | 439 | 440 |

TABLE 19

CLDN18.2 × CD28 × CD137

| format | Molecule Name | Seq ID chain1 | seq ID chain2 | seq Id chain3 |
|---|---|---|---|---|
| CD28-scFvx4-1BB-scFv/Cldn-Fab | 284C1 | 500 | 405 | 418 |
| CD28-scFvx4-1BB-scFv/Cldn-Fab | 284C2 | 501 | 405 | 418 |
| 4-1BB-scFvxCD28-scFv/Cldn-Fab | 284C3 | 502 | 405 | 418 |
| 4-1BB-scFvxCD28-scFv/Cldn-Fab | 284C4 | 503 | 405 | 418 |

EXAMPLES

The compositions and methods described herein will be further understood by reference to the following examples, which are intended to be purely exemplary. The compositions and methods described herein are not limited in scope by the exemplified embodiments, which are intended as illustrations of single aspects only. Any methods that are functionally equivalent are within the scope of the invention. Various modifications of the compositions and methods described herein in addition to those expressly described herein will become apparent to those skilled in the art from the foregoing description and accompanying figures. Such modifications fall within the scope of the invention.

Example 1

Figure 2A:
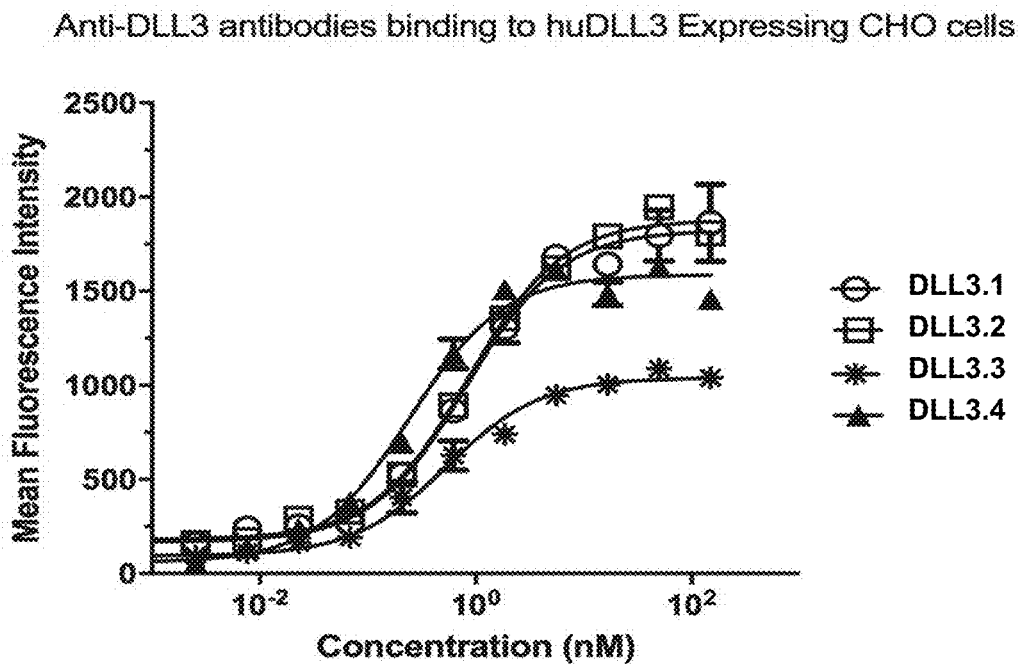
FIG. 2A is a graph that demonstrates the binding of anti-DLL3 antibodies to human DLL3 expressing CHO cells.

Humanized Anti-DLL3 Antibodies Binding to Human and Cynomolgus DLL3 Expressing CHO Cells To evaluate the ability of anti-DLL3 antibodies to bind, human serial dilutions of the anti-DLL3 antibodies were added to CHO-K1 cells (20,000 cells/well) over-expressing human or cyno DLL3. The mixtures were incubated at 4° C. for 20 minutes, washed 3 times, and stained with the secondary antibody, PE labeled F(ab')2-Goat anti-human IgG Fc (Thermo H10104) at 4° C. for 20 minutes. Cells were washed and resuspended in 7-Amino-Actinomycin D (7-AAD) solution and fixed in 10% neutral buffered formalin solution for 15 minutes before analysis with the iQue Intellicyt system. FIG. 2A is a graph of the concentration (nM) versus the mean fluorescence intensity.

Figure 2B:
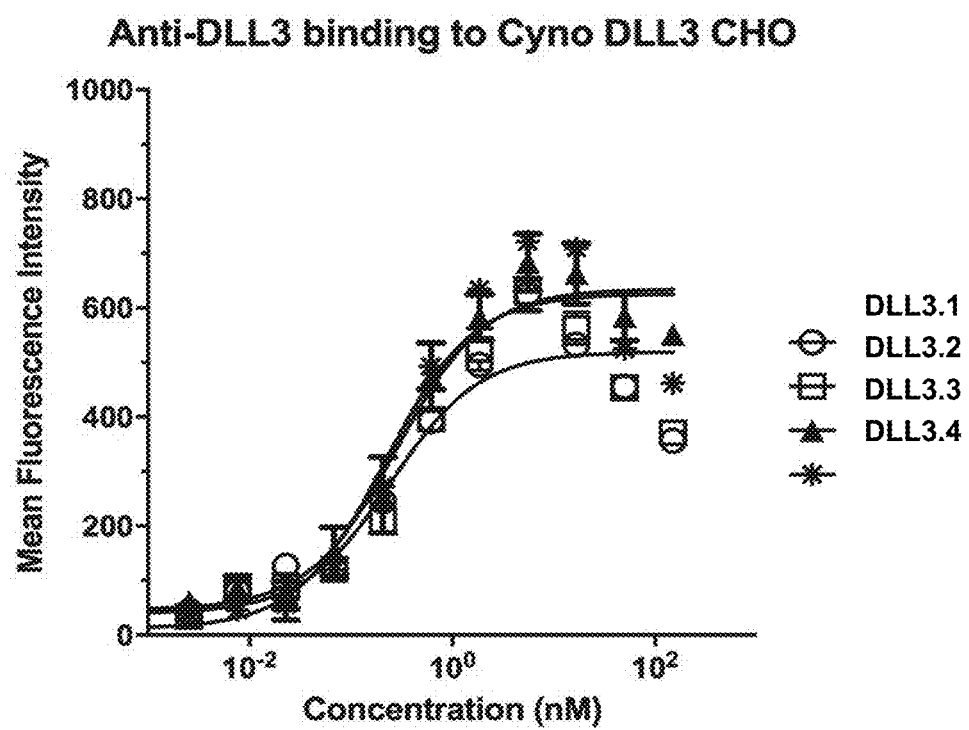
FIG. 2B is a graph that demonstrates the binding of anti-DLL3 antibodies to CHO cells expressing cynomulgus DLL3.

Four humanized antibodies were used in this example (DLL3.1, DLL3.2, DLL3.3, DLL3.4). The experiment was repeated with cynomolgus monkey DLL3 expressing CHO cells. FIG. 2B is a graph of the concentration (nM) of the antibodies versus the mean fluorescence intensity for binding to the cells.

Example 2

Anti-DLL3scfv-Fc Binding to huDLL3 Expressing CHO Cells

Figure 3:
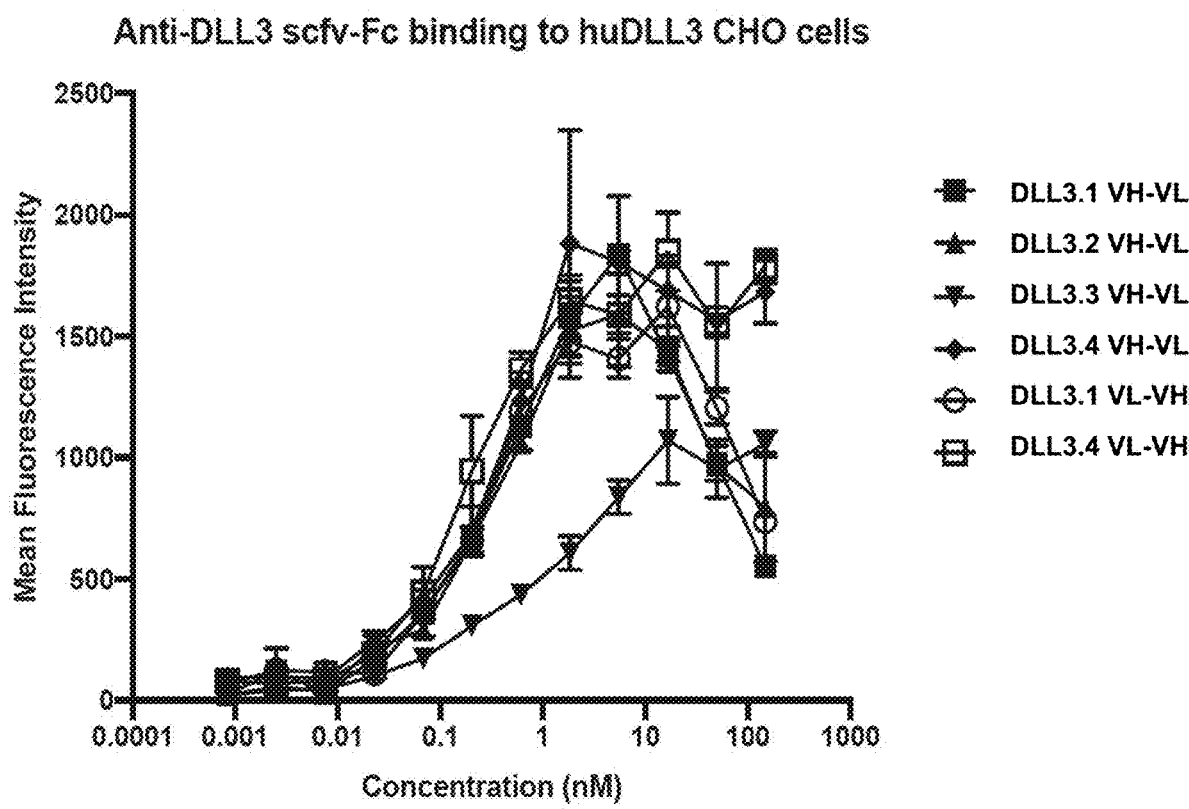
FIG. 3 is a graph that demonstrates the binding of anti-DLL3 scfv-Fc to human DLL3 expressing CHO cells.

The experiment was repeated to evaluate the ability of anti-DLL3scfv-Fc antibody fragment to bind human DLL3. FIG. 3 is a graph of the concentration (nM) of the DLL3 molecules versus the mean fluorescence intensity for binding to the cells. Six antibody fragments were used in this example (DLL3.1 VH-VL, DLL3.2 VH-VL, DLL3.3 VH-VL, DLL3.4 VH-VL, DLL3.1 VL-VH and DLL3.4 VL-VH).

Example 3

CD28scfv-CD3scFv-FcxDLL3-Fab-Fc Trispecific Molecule 328D3 Activates PBMCs to Secrete IFN Gamma in the Presence of CHO-DLL3 Cells to Higher Levels than the CD3scfv-FcxDLL3Fab-Fc Bispecific Molecule 3D1I or CD28scfv-FcxDLL3Fab-Fc Bispecific Molecule 28D18

Figure 4:
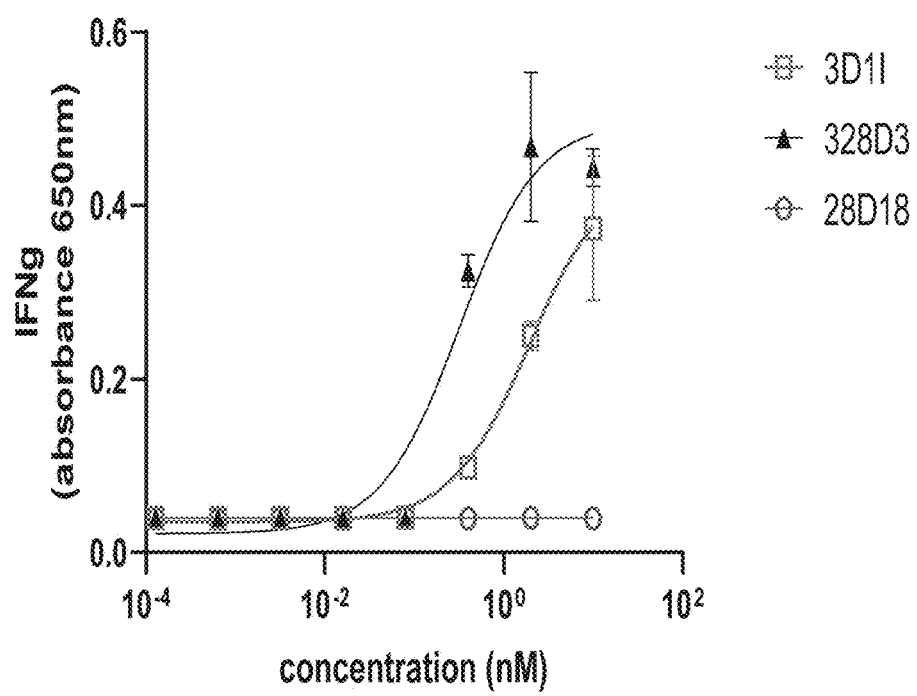
FIG. 4 is a graph that demonstrates CD28scfv-CD3scFv-FcxDLL3-Fab-Fc trispecific molecule 328D3 activates PBMCs to secrete IFN gamma in the presence of CHO-DLL3 cells to higher levels than the CD3scfv-FcxDLL3Fab-Fc bispecific molecule 3D11 or CD28scfv-FcxDLL3Fab-Fc bispecific molecule 28D18.

FIG. 4 is a graph of concentration (nM) of the molecules versus the IFNgamma as detected by ELISA (absorbance at 650 nm). The ELISA utilized high protein-binding 96-well plates that were coated overnight with 50 uL of mouse anti-human IFNgamma capture antibody at a concentration of 2 µg/ml. Plates were washed with PBS+0.05% Tween-20 (PBST) and blocked with 200ul PBS with 1% BSA. After washing, the coated plates were incubated for 120 minutes with 50 uL of the supernatant from the PBMC:Target cell cultures stimulated with the molecules. Plates were washed, and then incubated for 60 minutes with 50 uL of biotinylated mouse anti-human IFNgamma detection antibody at a concentration of 0.5 µg/ml. Plates were washed and incubated with streptavidin-HRP for 20 minutes. After washing, captured IFNgamma was quantified using 3,3',5,5'-tetramethylbenzidine (TMB)

Example 4

CD28scfv-CD3scFv-FcxDLL3-Fab-Fc Trispecific Molecule 32802 Activates PBMCs to Secrete IFNgamma in the Presence of CHO-DLL3 Cells to Higher Levels than the CD3scfv-FcxDLL3Fab-Fc Bispecific Molecule 3041 or CD28scfv-FcxDLL3Fab-Fc Bispecific Molecule 28015

Figure 5:
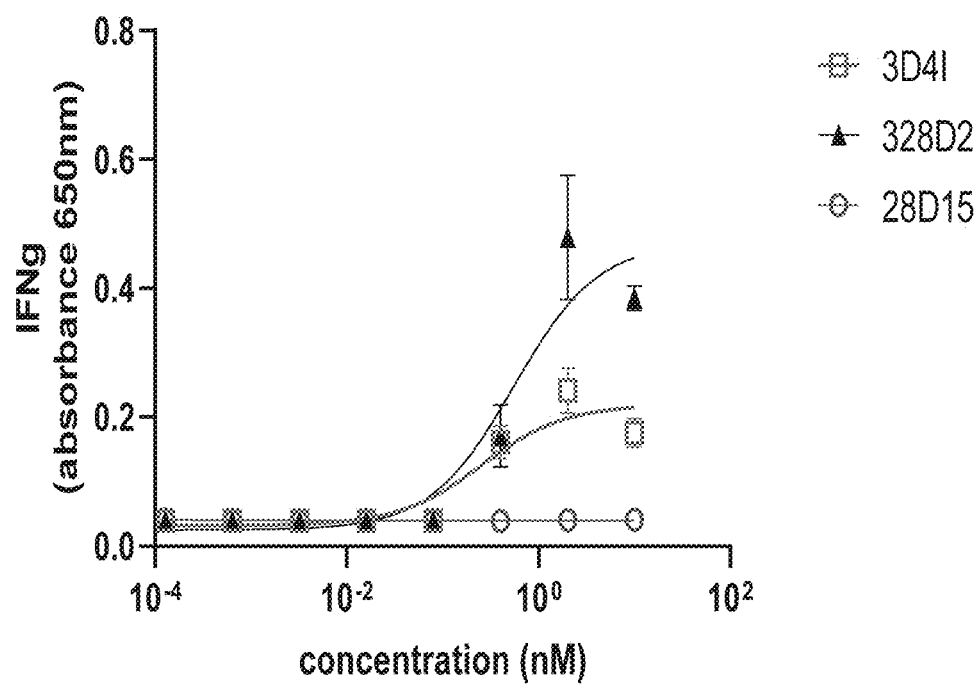
FIG. 5 is a graph that demonstrates CD28scfv-CD3scFv-FcxDLL3-Fab-Fc trispecific molecule 328D2 activates PBMCs to secrete IFNgamma in the presence of CHO-DLL3 cells to higher levels than the CD3scfv-FcxDLL3Fab-Fc bispecific molecule 3D41 or CD28scfv-FcxDLL3Fab-Fc bispecific molecule 28D15.

FIG. 5 is a graph of concentration (nM) of the molecules versus the IFNg (absorbance at 650 nm) as detected by ELISA as described in Example 3.

Example 5

CD28scfv-CD3scFv-FcxDLL3-Fab-Fc Trispecific Molecule 32801 Activates PBMCs to Secrete IFNgamma in the Presence of CHO-DLL3 Cells to Higher Levels than the CD3scfv-FcxDLL3Fab-Fc Bispecific Molecule 3D22I or CD28scfv-FcxDLL3Fab-Fc Bispecific Molecule 28017.

Figure 6:
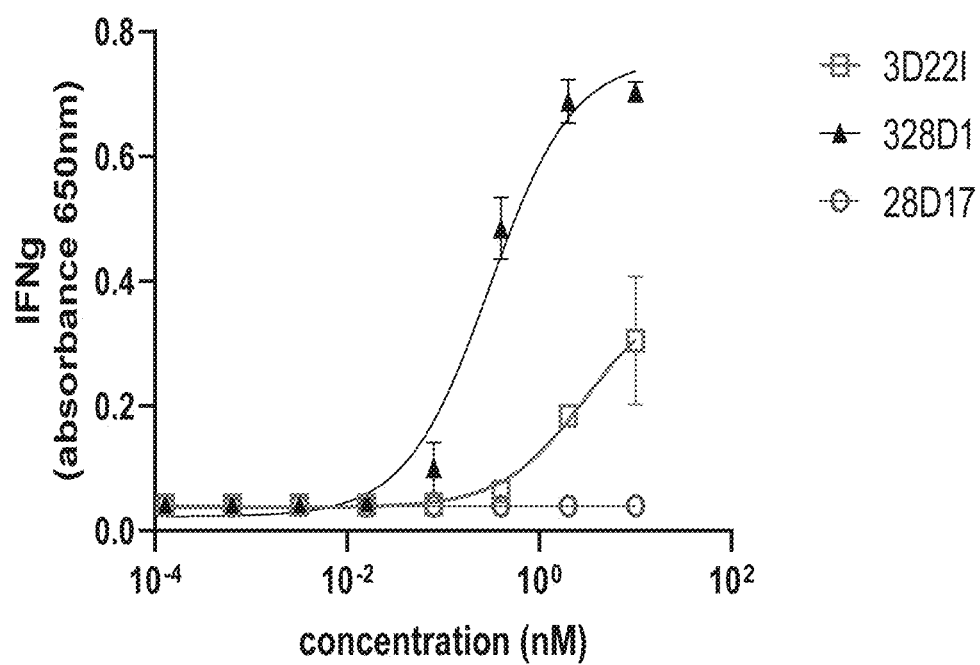
FIG. 6 is a graph that demonstrates CD28scfv-CD3scFv-FcxDLL3-Fab-Fc trispecific molecule 328D1 activates PBMCs to secrete IFNgamma in the presence of CHO-DLL3 cells to higher levels than the CD3scfv-Fcx DLL3Fab-Fc bispecific molecule 3D22I or CD28scfv-Fcx DLL3Fab-Fc bispecific molecule 28D17

FIG. 6 is a graph of concentration (nM) of the molecules versus the IFNg (absorbance at 650 nm) as detected by ELISA as described in Example 3.

Example 6

Figure 7:
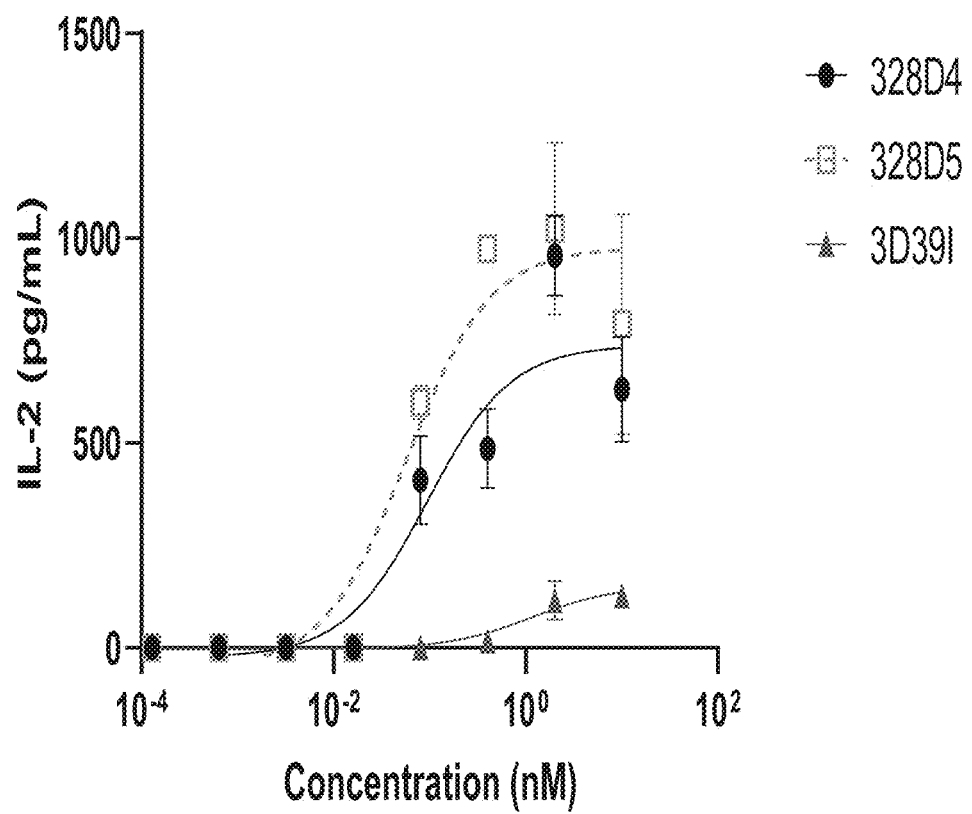
FIG. 7 is a graph that demonstrates CD28scfv-CD3scFv-Fcx DLL3-Fab-Fc trispecific molecules 328D4 and 328D5 activate PBMCs to secrete more IL-2 in the presence of NCI-H82 cells greater than the CD3scfv-Fcx DLL3Fab-Fc bispecific, 3D391.

CD28scfv-CD3scFv-FcxDLL3-Fab-Fc Trispecific Molecules 32804 and 32805 Activate PBMCs to Secrete More IL-2 in the Presence of NCI-H82 Cells Greater than the CD3scfv-FcxDLL3Fab-Fc Bispecific, 3D39I FIG. 7 is a graph of concentration (nM) versus the IFNg (absorbance at 650 nm). After 48 hours of culture, T cell activation was measured as an increase in IL-2 secreted into the medium. IL-2 secretion was measured using an IL-2 ELISA. The ELISA utilized high protein-binding 96-well plates that were coated overnight with 50 µL of mouse anti-human IL-2 capture antibody at a concentration of 2 µg/ml. Plates were washed with PBS+0.05% Tween-20 (PBST) and blocked with 200 µL PBS with 1% BSA. After washing, the coated plates were incubated for 120 minutes with 50 µL of the supernatant from the PBMC:Target cell cultures stimulated with bispecific molecules. Plates were washed, and then incubated for 60 minutes with 50 µL of biotinylated mouse anti-human IL-2 detection antibody at a concentration of 0.5 µg/ml. Plates were washed and incubated with streptavidin-HRP for 20 minutes. After washing, captured IL-2 was quantified using 3,3',5,5'-tetramethylbenzidine (TMB).

Example 7

MUC17xCD3 Bispecifics Bind Muc17-CHOK1 and ASPC1 Cells

Seven humanized antibodies, 1MU11A, 1MU32A, 1MU36A, 1MU16A, 1MU37A, 1MU43A, and 1MU47A, were assessed for the ability to bind to CHO-K1 cells expressing the membrane proximal fragment of MUC17.

Figures 11A, 11B:
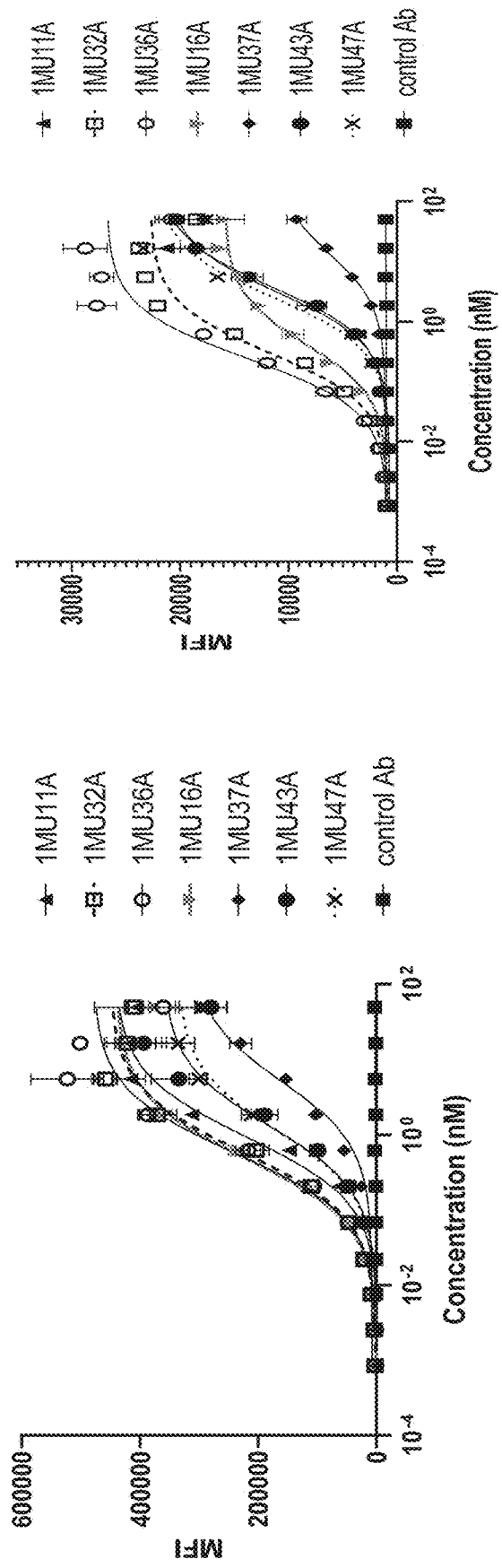
FIG. 11A is a graph that demonstrates MUC17xCD3 Bispecifics bind CHOK1 cells expressing MUC17.
FIG. 11B is a graph that demonstrates MUC17xCD3 Bispecifics bind to ASPC1 tumor cells.

To evaluate the ability of anti-MUC17 antibodies to bind cell expressed MUC17, serial dilutions of the anti-MUC17 antibodies were added to the MUC17 expressing CHO-K1 cells at a concentration of 20,000 cells/well. The antibody: cell mixtures were incubated at 4° C. for 20 minutes, washed 3 times, and stained with the secondary antibody, PE labeled F(ab')2-Goat anti-human IgG Fc (Thermo H10104) at 4° C. for 20 minutes. Cells were washed and resuspended in 7-Amino-Actinomycin D (7-AAD) solution and fixed in 10% neutral buffered formalin solution for 15 minutes before analysis with the iQue Intellicyt system. FIG. 11A is a graph of the concentration (nM) versus the mean fluorescence intensity (MFI) of binding to MUC17-CHO cells.

The experiment was repeated with APSC1 cells, which endogenously express full length human MUC17. FIG. 11B shows a graph of the concentration (nM) versus the mean fluorescence intensity (MFI) for the antibodies binding to the ASPC1 cells.

Example 8 hu1MU11A and hu1MU32A Retain Muc17 Binding Activity in the Scfv Format

Figure 12:
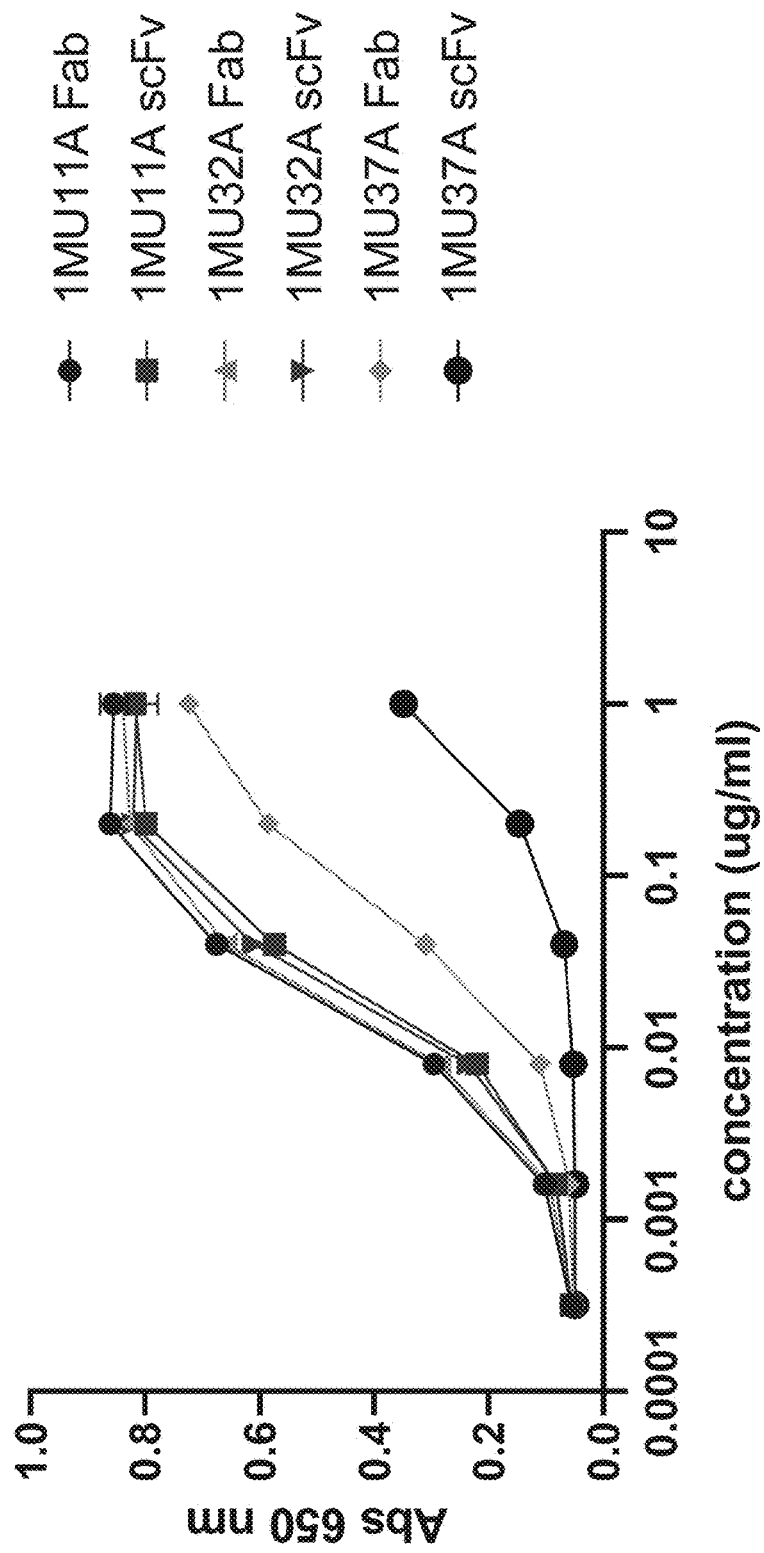
FIG. 12 graph showing hu1MU11A and hu1MU32A retain Muc17 binding activity in the Scfv format.

FIG. 12 is a graph of concentration (nM) of the Fab-Fc and Scfv-Fc versions of the molecules versus absorbance at 650 nm for binding to MUC17.

Example 9

CD3xCD28xMuc17 Trispecific Molecules have Similar Maximum Killing of ASPC1 Cells by PBMCs as the CD3 Bispecific 3M621

Figure 13:
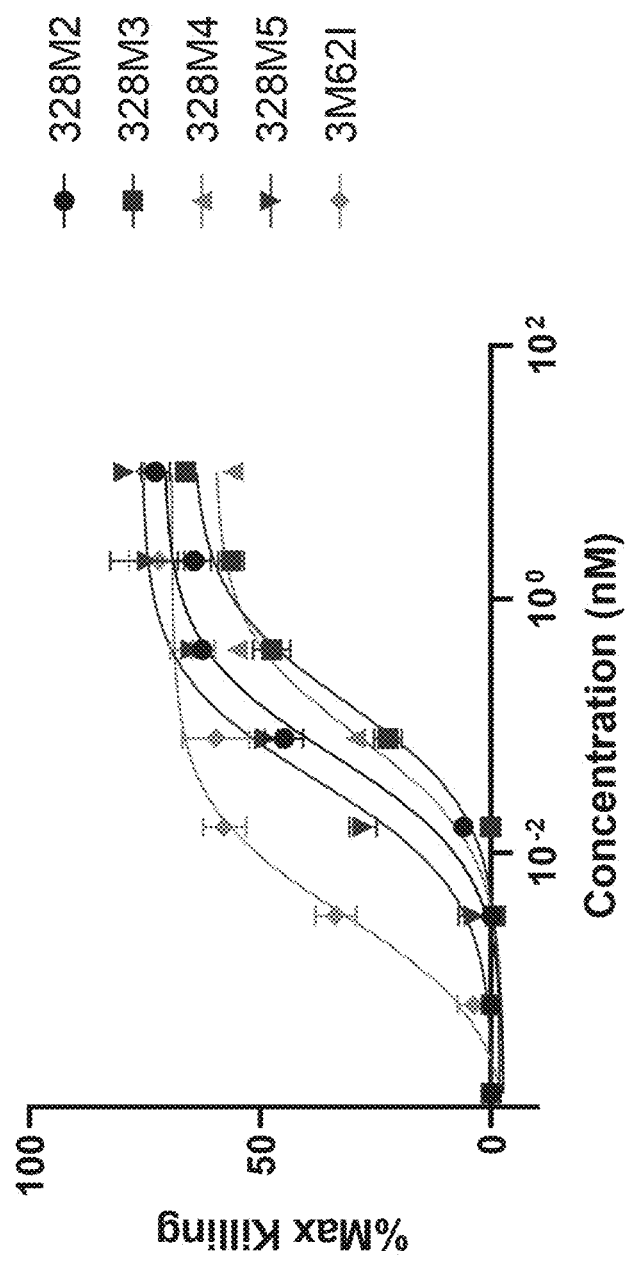
FIG. 13 is a graph that demonstrates CD3xCD28xMuc17 trispecific molecules have similar maximum killing of ASPC1 cells by PBMCs as the CD3 bispecific 3M621.

The experiment was conducted to evaluate the ability of human peripheral mononuclear (PBMCs) effector cells to kill Muc17 expressing CHO target cells when stimulated by MUC17xCD3xCD28 trispecific molecules. Cell cytotoxicity was determined as the amount of lactate dehydrogenase (LDH) released from damaged cells as a percent of the total LDH release with 1% Triton-X (Max Killing) added to the cell mixtures at time 0. For the cytotoxicity assays, target (MUC17-CHO or ASPC1) and effector cells (human PBMCs) were suspended in 200ul of medium containing 10% serum at an effector to target ratio of 10:1, in a 96-well plate. Dilutions of the bispecific molecules were added to the cultures in triplicate. The 96-well plates were cultured at 37° C. for 48 hours. The cells were then centrifuged at 250×g for 10 min, and 100 µl of the supernatant plus were transferred into corresponding wells of an optically clear 96-well plate containing 100 µl LDH assay reagent per well. The plates were then incubated for up to 30 min at room temperature. The absorbance of all samples was measured at 490-500 nm using a microtiter plate reader. FIG. 13 is a graph of the concentration (nM) of the molecules versus % of maximum killing.

Example 10

Muc17×CD3×cD28 Trispecific Molecules 328M2, 328M 3, 328M 4, and 328M 5 Activate PBMCs in the Presence of ASPC1 Cells to Secrete IL-2 at Levels Higher than that of the CD3 Bispecific, 3M621

Figure 14:
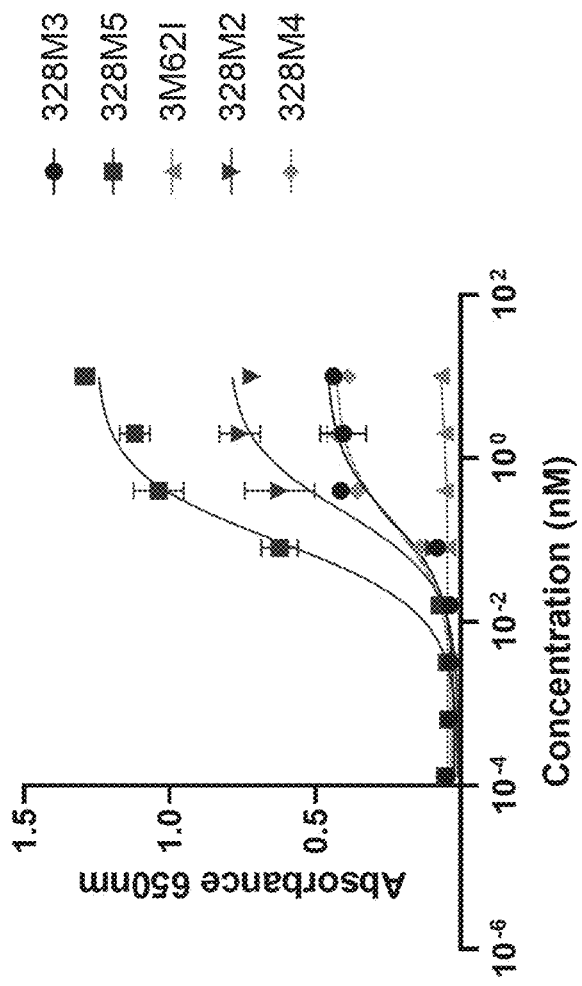
FIG. 14 is a graph that demonstrates Muc17xCD3xcD28 Trispecific molecules 328M2, 328M 3, 328M4, and 328M5 activate PBMCs in the presence of ASPC1 cells to secrete IL-2 at levels higher than that of the CD3 bispecific, 3M621.

FIG. 14 is a graph of concentration (nM) of the molecules versus absorbance at 650 nm from the ELISA to detect secreted IL-2 in the media as described in Example 6.

Example 11

Figure 15:
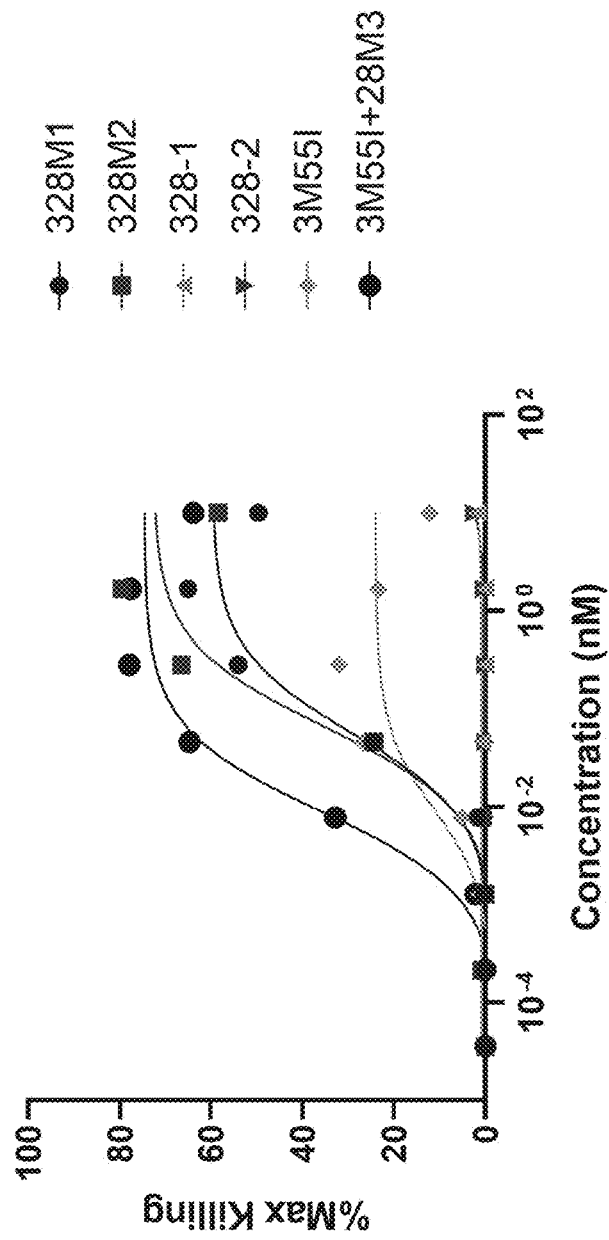
FIG. 15 is a graph that demonstrates CD3ScfvxCD28-scFvxMuc17Fab trispecifc molecules 328M1 and 328M2 activate T-cells to kill MUC17-CHO cells better than the CD3 bispecific 3M551, and similar to the combination of CD3 and CD28 bispecifics, 3M551+28M3.

CD3Scfv×CD28SScfv×MUC17-Fab trispecific molecules 328M1 and 328M2 activate T-cells to kill MUC17-CHO cells better than the CD3 bispecific 3M551, and similar to the combination of CD3 and CD28 bispecifics, 3M551+28M3. FIG. 15 is a graph of the concentration (nM) of the molecules versus % of maximum killing.

Example 12

CD28scfv×CD3scfv×Muc17Fab Trispecific 328M2 Activates PBMCs to Express CD25 Only when in the Presence of Muc17 Expressing CHO Cells and Cannot Activate without Muc17 Target Cells. In Contrast the CD3scFv×CD28scFv×Muc17-Fab Trispecific 328M1 is Able to Non-Specifically Activate Cells in the Absence of Muc17, Similarly to the Bispecific Lacking Muc17 Binding, 328-1

FIG. 16A shows the expression of CD25(MFI) stimulated by increasing concentrations of the bispecific and trispecific molecules T cells when PBMCs are in the presence of MUC17 expressing CHO cells, showing both 328M1 and 328M2 active T cells to express CD25 similarly.

FIG. 16B shows the expression of CD25(MFI) stimulated by increasing concentrations of the bispecific and trispecific molecules T cells when PBMCs are in the presence of parental CHO cells, showing 328M1 stimulates T cells whereas 328M2 can not stimulate without MUC17 expressing cells. Similarly, 328-1, which lacks the anti-MUC17 Fab, also activates T cells in the absence of MUC17 target cells, whereas 328-2 cannot.

Versions –1 have the configuration CD3Scfv-CD28Scfv-Fc×MUC17Fab-Fc or Fc and versions –2 have the configuration CD28scfv-CD3Scfv-Fc×MUC17Fab-Fc or Fc. This indicates the version –2 configuration, CD28scfv-CD3Scfv-Fc, has improved properties over the version –1 configuration, CD3Scfv-CD28Scfv-Fc, because version–2 configuration requires the presence of target cells to activate T cells and thus is less likely to cause non-specific activation of T cells and potential toxicity.

Example 13

CD137×CD3×Muc17 Trispecific Molecules 34M1 and 34M4 Increase CD4 and CD8 T Cell Numbers when PBMCs are Cultured with Muc17 Expressing CHO Cells to a Greater Level than the Benchmark CD3 Bispecific 3M8B7

FIG. 17A is a graph of concentration of the molecules in nM (treatment (nM)) versus CD8+ cell counts as determined by staining the cells with fluorescently labeled antibodies against CD3 and CD4 or CD8 and assessment by flow cytometry FIG. 17B is a graph of concentration of the molecules in nM (treatment (nM)) versus CD4+ cell counts as determined by staining the cells with fluorescently labeled antibodies against CD3 and CD4 or CD8 and assessment by flow cytometry

Example 14

Trispecific Molecules 328C1, 328C 2, 328C3, 328C4 Activate T-Cells to Secrete IL-2 Better to a Greater Level than the 3C27I CD3×Cldn18.2 Bite Alone.

Figure 21:
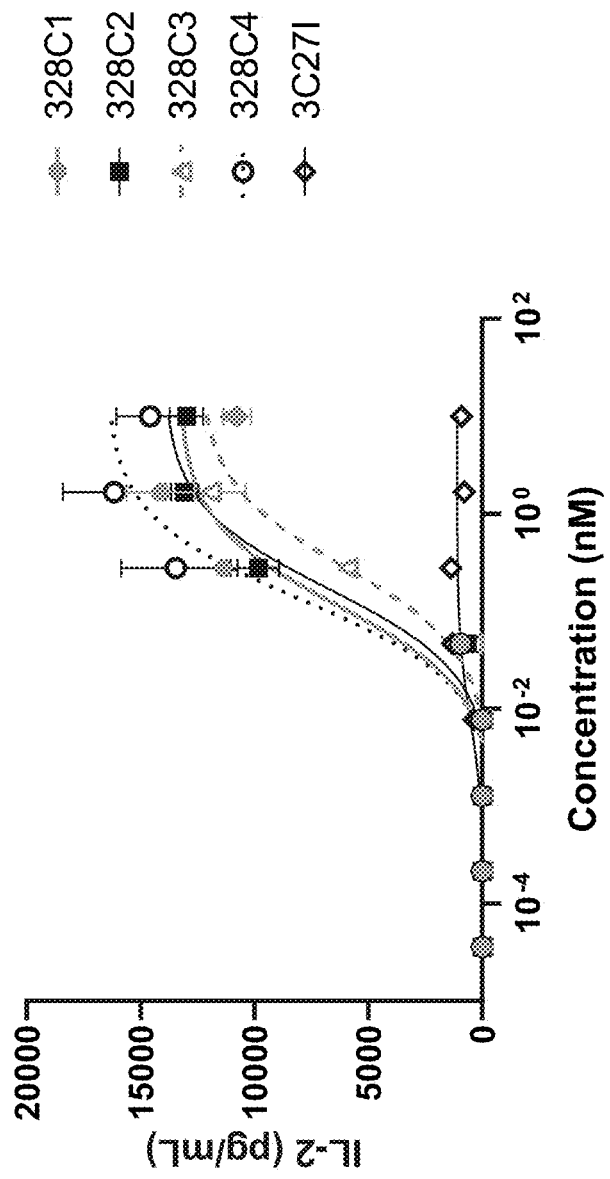
FIG. 21 is a graph that demonstrates trispecific molecules 328C1, 328C 2, 328C3, 328C4 activate T-cells to secrete IL-2 better to a greater level than the 3C27I CD3x CLDN18.2 bispecific alone.

FIG. 21 is a graph of concentration (nM) of the molecules versus concentration of secreted IL-2 (pg/mL) as determined by ELISA.

Example 15

Figure 22:
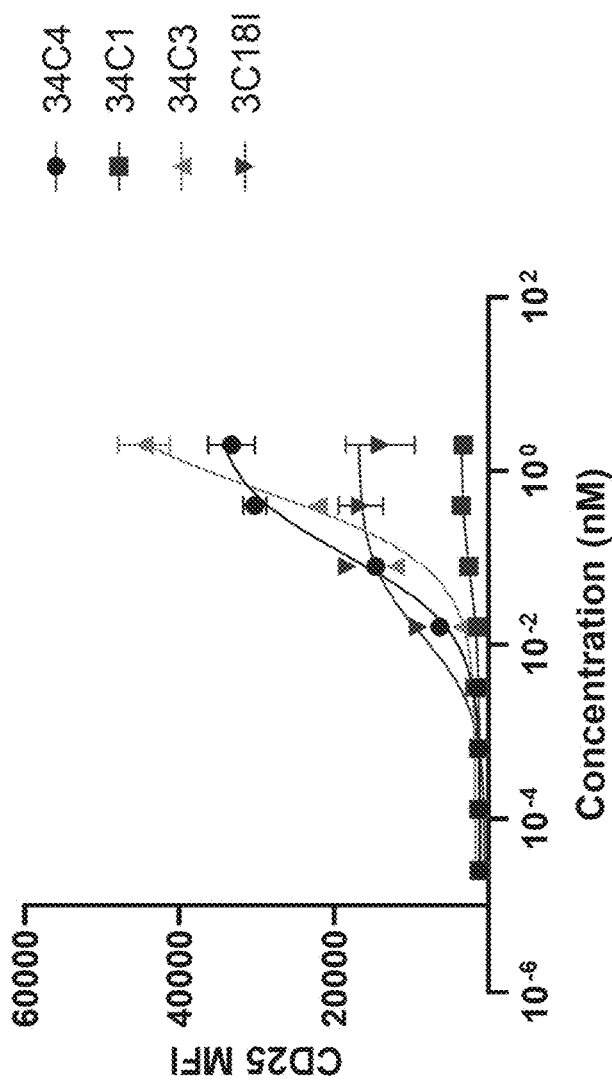
FIG. 22 is a graph that demonstrates CD3xCD137x CLDN18.2 trispecific molecules 34C4 and 34C3 activate PBMCs in the presence of SNU-601 cells to express more CD25 than bispecific 3C18I.

CD3×CD137×CLDN18.2 Trispecific Molecules 34C4 and 34C3 Activate PBMCs in the Presence of SNU-601 Cells to Express More CD25 than 3C18I FIG. 22 is a graph of the concentration (nM) of the molecules versus CD25 mean fluorescence intensity (MFI) on CD3+ T cells from the cultures.

Example 16

Figure 23:
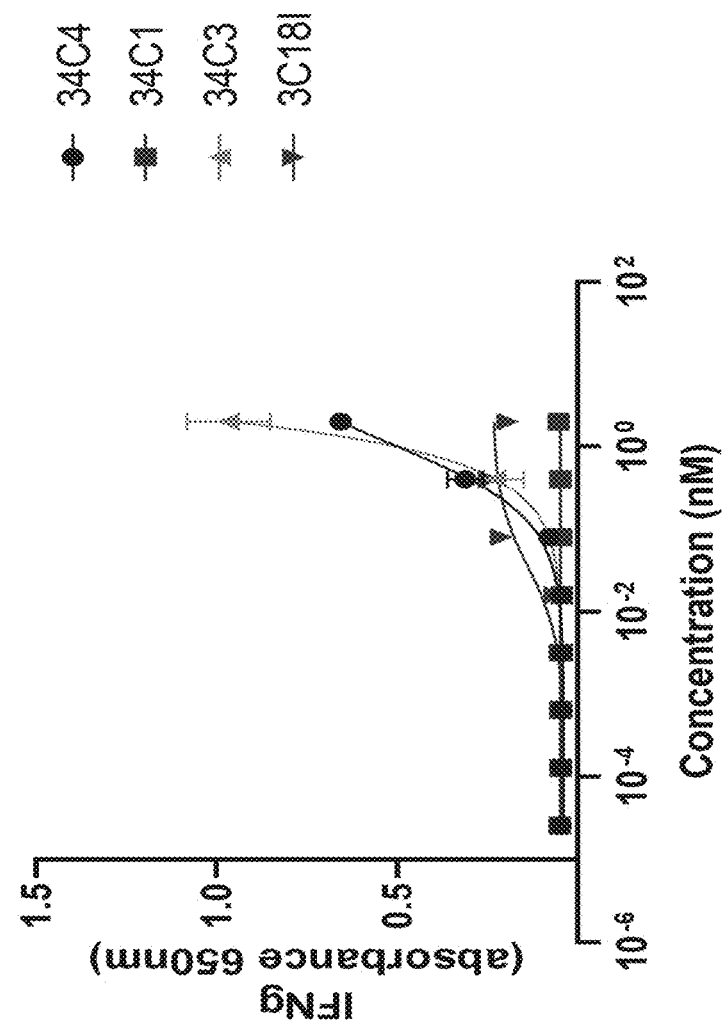
FIG. 23 is a graph that demonstrates CD3xCD137x CLDN18.2 trispecific molecules 34C4 and 34C3 activate PBMCs in the presence of SNU-601 cells to secrete more IFNgamma than bispecific 3C18I alone.

CD3×CD137×CLDN18.2 trispecific molecules 34C4 and 34C3 activate PBMCs in the presence of SNU-601 cells to secrete more IFNgamma than 3C18I alone FIG. 23 is a graph of the concentration (nM) of the molecules versus IFNg (absorbance at 650 nm) as determined by ELISA.

Example 17

CD3×CD137×CLDN18.2 Trispecific 34C3 Increases CD8 T Cell Numbers Beyond What is Stimulated by the CD3 T Cell Engager 3C27I in the Presence of CHO Cells Expressing CLDN18.2

Figure 24:
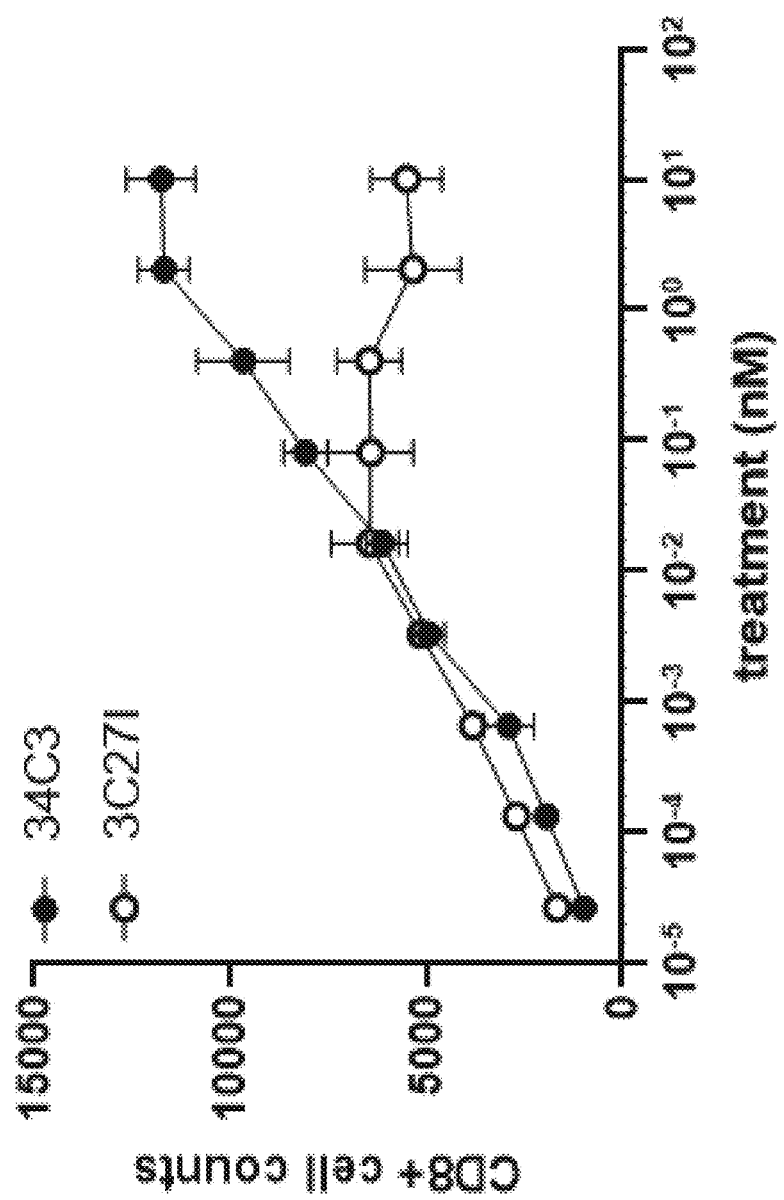
FIG. 24 is a graph that demonstrates CD3xCD137x CLDN18.2 trispecific 34C3 increases CD8 T cell numbers beyond what is stimulated by the CD3 T cell engager 3C27I in the presence of CHO cells expressing CLDN18.2.

FIG. 24 is a graph of the concentration of the molecules in nM (treatment (nM)) versus CD8+ cell counts as determined by flow cytometry from the cultures.

The therapeutic method of the present specification may include the step of administering the composition including the antibody at a pharmaceutically effective amount. The total daily dose should be determined through appropriate medical judgment by a physician, and administered once or several times. The specific therapeutically effective dose level for any particular patient may vary depending on various factors well known in the medical art, including the kind and degree of the response to be achieved, concrete compositions according to whether other agents are used therewith or not, the patient's age, body weight, health condition, gender, and diet, the time and route of administration, the secretion rate of the composition, the time period of therapy, other drugs used in combination or coincident with the composition disclosed herein, and like factors well known in the medical arts.

In still another aspect, the present specification provides a use of the therapeutic protein or the pharmaceutical composition including the same in the preparation of drugs for the prevention or treatment of cancer, a neurodegenerative or an infectious disease.

In one embodiment, the dose of the composition may be administered daily, semi-weekly, weekly, bi-weekly, or monthly. The period of treatment may be for a week, two weeks, a month, two months, four months, six months, eight months, a year, or longer. The initial dose may be larger than a sustaining dose. In one embodiment, the dose ranges from a weekly dose of at least 0.01 mg/kg, at least 0.25 mg/kg, at least 0.3 mg/kg, at least 0.5 mg/kg, at least 0.75 mg/kg, at least 1 mg/kg, at least 2 mg/kg, at least 3 mg/kg, at least 4 mg/kg, at least 5 mg/kg, at least 6 mg/kg, at least 7 mg/kg, at least 8 mg/kg, at least 9 mg/kg, at least 10 mg/kg, at least 15 mg/kg, at least 20 mg/kg, at least 25 mg/kg, or at least 30 mg/kg In one embodiment, a weekly dose may be at most 1.5 mg/kg, at most 2 mg/kg, at most 2.5 mg/kg, at most 3 mg/kg, at most 4 mg/kg, at most 5 mg/kg, at most 6 mg/kg, at most 7 mg/kg, at most 8 mg/kg, at most 9 mg/kg, at most 10 mg/kg, at most 15 mg/kg, at most 20 mg/kg, at most 25 mg/kg, or at most 30 mg/kg. In a particular aspect, the weekly dose may range from 5 mg/kg to 20 mg/kg. In an alternative aspect, the weekly dose may range from 10 mg/kg to 15 mg/kg.

The present specification also provides a pharmaceutical composition for the administration to a subject. The pharmaceutical composition disclosed herein may further include a pharmaceutically acceptable carrier, excipient, or diluent. As used herein, the term "pharmaceutically acceptable" means that the composition is sufficient to achieve the therapeutic effects without deleterious side effects, and may be readily determined depending on the type of the diseases, the patient's age, body weight, health conditions, gender, and drug sensitivity, administration route, administration mode, administration frequency, duration of treatment, drugs used in combination or coincident with the composition disclosed herein, and other factors known in medicine.

The pharmaceutical composition including the antibody disclosed herein may further include a pharmaceutically acceptable carrier. For oral administration, the carrier may include, but is not limited to, a binder, a lubricant, a disintegrant, an excipient, a solubilizer, a dispersing agent, a stabilizer, a suspending agent, a colorant, and a flavorant. For injectable preparations, the carrier may include a buffering agent, a preserving agent, an analgesic, a solubilizer, an isotonic agent, and a stabilizer. For preparations for topical administration, the carrier may include a base, an excipient, a lubricant, and a preserving agent.

The disclosed compositions may be formulated into a variety of dosage forms in combination with the aforementioned pharmaceutically acceptable carriers. For example, for oral administration, the pharmaceutical composition may be formulated into tablets, troches, capsules, elixirs, suspensions, syrups or wafers. For injectable preparations, the pharmaceutical composition may be formulated into an ampule as a single dosage form or a multidose container. The pharmaceutical composition may also be formulated into solutions, suspensions, tablets, pills, capsules and long-acting preparations.

On the other hand, examples of the carrier, the excipient, and the diluent suitable for the pharmaceutical formulations include, without limitation, lactose, dextrose, sucrose, sorbitol, mannitol, xylitol, erythritol, maltitol, starch, acacia rubber, alginate, gelatin, calcium phosphate, calcium silicate, cellulose, methylcellulose, microcrystalline cellulose, polyvinylpyrrolidone, water, methylhydroxybenzoate, propylhydroxybenzoate, talc, magnesium stearate and mineral oils. In addition, the pharmaceutical formulations may further include fillers, anti-coagulating agents, lubricants, humectants, flavorants, and antiseptics.

Further, the pharmaceutical composition disclosed herein may have any formulation selected from the group consisting of tablets, pills, powders, granules, capsules, suspensions, liquids for internal use, emulsions, syrups, sterile aqueous solutions, non-aqueous solvents, lyophilized formulations and suppositories.

The composition may be formulated into a single dosage form suitable for the patient's body, and preferably is formulated into a preparation useful for peptide drugs according to the typical method in the pharmaceutical field so as to be administered by an oral or parenteral route such as through skin, intravenous, intramuscular, intra-arterial, intramedullary, intramedullary, intraventricular, pulmonary, transdermal, subcutaneous, intraperitoneal, intranasal, intracolonic, topical, sublingual, vaginal, or rectal administration, but is not limited thereto.

The composition may be used by blending with a variety of pharmaceutically acceptable carriers such as physiological saline or organic solvents. In order to increase the stability or absorptivity, carbohydrates such as glucose, sucrose or dextrans, antioxidants such as ascorbic acid or glutathione, chelating agents, low molecular weight proteins or other stabilizers may be used.

The administration dose and frequency of the pharmaceutical composition disclosed herein are determined by the type of active ingredient, together with various factors such as the disease to be treated, administration route, patient's age, gender, and body weight, and disease severity.

The total effective dose of the compositions disclosed herein may be administered to a patient in a single dose, or may be administered for a long period of time in multiple doses according to a fractionated treatment protocol. In the pharmaceutical composition disclosed herein, the content of active ingredient may vary depending on the disease severity. Preferably, the total daily dose of the peptide disclosed herein may be approximately 0.0001 µg to 500 mg per 1 kg of body weight of a patient. However, the effective dose of the peptide is determined considering various factors including patient's age, body weight, health conditions, gender, disease severity, diet, and secretion rate, in addition to administration route and treatment frequency of the pharmaceutical composition. In view of this, those skilled in the art may easily determine an effective dose suitable for the particular use of the pharmaceutical composition disclosed herein. The pharmaceutical composition disclosed herein is not particularly limited to the formulation, and administration route and mode, as long as it shows suitable effects.

Moreover, the pharmaceutical composition may be administered alone or in combination or coincident with other pharmaceutical formulations showing prophylactic or therapeutic efficacy.

In still another aspect, the present specification provides a method for preventing or treating of cancer, infectious diseases or neurodegenerative diseases comprising the step of administering to a subject the chimeric protein or the pharmaceutical composition including the same.

Given the teachings and guidance provided herein, those skilled in the art will understand that a formulation described herein can be equally applicable to many types of biopharmaceuticals, including those exemplified, as well as others known in the art. Given the teachings and guidance provided herein, those skilled in the art also will understand that the selection of, for example, type(s) or and/or amount(s) of one or more excipients, surfactants and/or optional components can be made based on the chemical and functional compatibility with the biopharmaceutical to be formulated and/or the mode of administration as well as other chemical, functional, physiological and/or medical factors well known in the art. For example, non-reducing sugars exhibit favorable excipient properties when used with polypeptide biopharmaceuticals compared to reducing sugars. Accordingly, exemplary formulations are exemplified further herein with reference to polypeptide biopharmaceuticals. However, the range of applicability, chemical and physical properties, considerations and methodology applied to polypeptide biopharmaceutical can be similarly applicable to biopharmaceuticals other than polypeptide biopharmaceuticals.

In various embodiments, a formulation can include, without limitation, combinations of bioactive agents (such as viruses, proteins, antibodies, peptides and the like as described herein) in the formulation. For example, a formulation as described herein can include a single bioactive agent for treatment of one or more conditions, including without limitation, disease. A formulation as described herein also can include, in an embodiment, without limitation, two or more different bioactive agents for a single or multiple conditions. Use of multiple bioactive agents in a formulation can be directed to, for example, the same or different indications. Similarly, in another embodiment, multiple bioactive agents can be used in a formulation to treat, for example, both a pathological condition and one or more side effects caused by the primary treatment. In a further embodiment, multiple bioactive agents also can be included, without limitation, in a formulation as described herein to accomplish different medical purposes including, for example, simultaneous treatment and monitoring of the progression of the pathological condition. In an additional embodiment, multiple, concurrent therapies such as those exemplified herein as well as other combinations well known in the art are particularly useful for patient compliance because a single formulation can be sufficient for some or all suggested treatments and/or diagnosis. Those skilled in the art will know those bioactive agents that can be admixed for a wide range of combination therapies. Similarly, in various embodiments, a formulation can be used with a small molecule drug and combinations of one or more bioactive agents together with one or more small molecule pharmaceuticals. Therefore, in various embodiments a formulation is provided containing 1, 2, 3, 4, 5 or 6 or more different bioactive agents, as well as, for one or more bioactive agents combined with one or more small molecule pharmaceuticals.

In various embodiments, a formulation can include, one or more preservatives and/or additives known in the art. Similarly, a formulation can further be formulated, without limitation, into any of various known delivery formulations. For example, in an embodiment, a formulation can include, surfactants, adjuvant, biodegradable polymers, hydrogels, etc., such optional components, their chemical and functional characteristics are known in the art. Similarly known in the art are formulations that facilitate rapid, sustained or delayed release of the bioactive agents after administration. A formulation as described can be produced to include these or other formulation components known in the art.

The composition can therefore be administered as a single dose, or as two or more doses (which may or may not contain the same amount of the desired molecule) over time, or as a continuous infusion via an implantation device or catheter. Further refinement of the appropriate dosage is routinely made by those of ordinary skill in the art and is within the ambit of tasks routinely performed by them. Appropriate dosages may be ascertained through use of appropriate dose-response data. In various embodiments, the bioactive agents in formulations described herein can, without limitation, be administered to patients throughout an extended time period, such as chronic administration for a chronic condition. The composition can be a solid, a semi-solid or an aerosol and a pharmaceutical compositions is formulated as a tablet, geltab, lozenge, orally dissolved strip, capsule, syrup, oral suspension, emulsion, granule, sprinkle or pellet.

In an embodiment, for oral, rectal, vaginal, parenteral, pulmonary, sublingual and/or intranasal delivery formulations, tablets can be made by compression or molding, optionally with one or more accessory ingredients or additives. In an embodiment, compressed tablets are prepared, for example, by compressing in a suitable tabletting machine, the active ingredients in a free-flowing form such as a powder or granules, optionally mixed with a binder (for example, without limitation, povidone, gelatin, hydroxypropylmethyl cellulose), lubricant, inert diluent, preservative, disintegrant (for example, without limitation, sodium starch glycolate, cross-linked povidone, cross-linked sodium carboxymethyl cellulose) and/or surface-active or dispersing agent.

In an embodiment, molded tablets are made, for example, without limitation, by molding in a suitable tabletting machine, a mixture of powdered compounds moistened with an inert liquid diluent. In an embodiment, the tablets may optionally be coated or scored, and may be formulated so as to provide slow or controlled release of the active ingredients, using, for example, without limitation, hydroxypropylmethyl cellulose in varying proportions to provide the desired release profile. In an embodiment, tablets may optionally be provided with a coating, without limitation, such as a thin film, sugar coating, or an enteric coating to provide release in parts of the gut other than the stomach. In an embodiment, processes, equipment, and toll manufacturers for tablet and capsule making are well-known in the art.

In an embodiment, capsule formulations can utilize either hard or soft capsules, including, without limitation, gelatin capsules or vegetarian capsules such as those made out of hydroxymethylpropylcellulose (HM PC). In an embodiment, a type of capsule is a gelatin capsule. In an embodiment, capsules may be filled using a capsule filling machine such as, without limitation, those available from commercial suppliers such as Miranda International or employing capsule manufacturing techniques well-known in the industry, as described in detail in Pharmaceutical Capules, 2.sup.nd Ed., F. Podczeck and B. Jones, 2004. In an embodiment, capsule formulations may be prepared, without limitation, using a toll manufacturing center such as the Chao Center for Industrial Pharmacy & Contract Manufacturing, located at Purdue Research Park.

Packaging and instruments for administration may be determined by a variety of considerations, such as, without limitation, the volume of material to be administered, the conditions for storage, whether skilled healthcare practitioners will administer or patient self-compliance, the dosage regime, the geopolitical environment (e.g., exposure to extreme conditions of temperature for developing nations), and other practical considerations.

Injection devices include pen injectors, auto injectors, safety syringes, injection pumps, infusion pumps, glass prefilled syringes, plastic prefilled syringes and needle free injectors syringes may be prefilled with liquid, or may be dual chambered, for example, for use with lyophilized material. An example of a syringe for such use is the Lyo-Ject™, a dual-chamber pre-filled lyosyringe available from Vetter GmbH, Ravensburg, Germany. Another example is the LyoTip which is a prefilled syringe designed to conveniently deliver lyophilized formulations available from LyoTip, Inc., Camarillo, California, U.S.A. Administration by injection may be, without limitation intravenous, intramuscular, intraperitoneal, or subcutaneous, as appropriate. Administrations by non-injection route may be, without limitation, nasal, oral, cocular, dermal, or pulmonary, as appropriate.

In certain embodiments, kits can comprise, without limitation, one or more single or multi-chambered syringes (e.g., liquid syringes and lyosyringes) for administering one or more formulations described herein. In various embodiments, the kit can comprise formulation components for parenteral, subcutaneous, intramuscular or IV administration, sealed in a vial under partial vacuum in a form ready for loading into a syringe and administration to a subject. In this regard, the composition can be disposed therein under partial vacuum. In all of these embodiments and others, the kits can contain one or more vials in accordance with any of the foregoing, wherein each vial contains a single unit dose for administration to a subject.

The kits can comprise lyophilates, disposed as herein, that upon reconstitution provide compositions in accordance therewith. In various embodiment the kits can contain a lyophilate and a sterile diluent for reconstituting the lyophilate.

Also described herein, are methods for treating a subject in need of therapy, comprising administering to the subject an effective amount of a formulation as described herein. The therapeutically effective amount or dose of a formulation will depend on the disease or condition of the subject and actual clinical setting.

In an embodiment, a formulation as described herein can be administered by any suitable route, specifically by parental (including subcutaneous, intramuscular, intravenous and intradermal) administration. It will also be appreciated that the preferred route will vary with the condition and age of the recipient, and the disease being treated. Methods of determining the most effective means and dosage of administration are known to those of skill in the art and will vary, without limitation, with the composition used for therapy, the purpose of the therapy, and the subject being treated. Single or multiple administrations can be carried out, without limitation, the dose level and pattern being selected by the treating physician. Suitable dosage formulations and methods of administering the agents are known in the art.

The formulations as described herein can be used in the manufacture of medicaments and for the treatment of humans and other animals by administration in accordance with conventional procedures.

Also provided herein are combinatorial methods for developing suitable virus formulations using combinations of amino acids. These methods are effective for developing stable liquid or lyophilized formulations, and particularly pharmaceutical virus formulations.

Compositions in accordance with embodiments described herein have desirable properties, such as desirable solubility, viscosity, syringeability and stability. Lyophilates in accordance with embodiments described herein have desirable properties, as well, such as desirable recovery, stability and reconstitution.

In an embodiment, the pH of the pharmaceutical formulation is at least about 3.5, 3.75, 4, 4.25, 4.5, 4.75, 5, 5.25, 5.5, 5.75, 6, 6.25, 6.5, 6.75, 7, 7.25, 7.5, 7.75, 8, 8.25, 8.5, 8.75, or 9.

In an embodiment, the pH of the pharmaceutical formulation is from about 3 to about 9, about 4 to about 19, about 5 to about 9, about 6 to about 8, about 6 to about 7, about 6 to about 9, about 5 to about 6, about 5 to about 7, about 5 to about 8, about 4 to about 9, about 4 to about 8, about 4 to about 7, about 4 to about 6, about 4 to about 5, about 3 to about 8, about 3 to about 7, about 3 to about 6, about 3 to about 5, about 3 to about 4, about 7 to about 8, about 7 to about 9, about 7 to about 10.

Certain embodiments of the present invention are described herein, including the best mode known to the inventors for carrying out the invention. Of course, variations on these described embodiments will become apparent to those of ordinary skill in the art upon reading the foregoing description. The inventor expects skilled artisans to employ such variations as appropriate, and the inventors intend for the present invention to be practiced otherwise than specifically described herein. Accordingly, this invention includes all modifications and equivalents of the subject matter recited in the claims appended hereto as permitted by applicable law. Moreover, any combination of the above-described embodiments in all possible variations thereof is encompassed by the invention unless otherwise indicated herein or otherwise clearly contradicted by context.

Groupings of alternative embodiments, elements, or steps of the present invention are not to be construed as limitations. Each group member may be referred to and claimed individually or in any combination with other group members disclosed herein. It is anticipated that one or more members of a group may be included in, or deleted from, a group for reasons of convenience and/or patentability. When any such inclusion or deletion occurs, the specification is deemed to contain the group as modified thus fulfilling the written description of all Markush groups used in the appended claims.

Unless otherwise indicated, all numbers expressing a characteristic, item, quantity, parameter, property, term, and so forth used in the present specification and claims are to be understood as being modified in all instances by the term "about." As used herein, the term "about" means that the characteristic, item, quantity, parameter, property, or term so qualified encompasses a range of plus or minus ten percent above and below the value of the stated characteristic, item, quantity, parameter, property, or term. Accordingly, unless indicated to the contrary, the numerical parameters set forth in the specification and attached claims are approximations that may vary. At the very least, and not as an attempt to limit the application of the doctrine of equivalents to the scope of the claims, each numerical indication should at least be construed in light of the number of reported significant digits and by applying ordinary rounding techniques. Notwithstanding that the numerical ranges and values setting forth the broad scope of the invention are approximations, the numerical ranges and values set forth in the specific examples are reported as precisely as possible. Any numerical range or value, however, inherently contains certain errors necessarily resulting from the standard deviation found in their respective testing measurements. Recitation of numerical ranges of values herein is merely intended to serve as a shorthand method of referring individually to each separate numerical value falling within the range. Unless otherwise indicated herein, each individual value of a numerical range is incorporated into the present specification as if it were individually recited herein.

The terms "a," "an," "the" and similar referents used in the context of describing the present invention (especially in the context of the following claims) are to be construed to cover both the singular and the plural, unless otherwise indicated herein or clearly contradicted by context. All methods described herein can be performed in any suitable order unless otherwise indicated herein or otherwise clearly contradicted by context. The use of any and all examples, or exemplary language (e.g., "such as") provided herein is intended merely to better illuminate the present invention and does not pose a limitation on the scope of the invention otherwise claimed. No language in the present specification should be construed as indicating any non-claimed element essential to the practice of the invention.

Specific embodiments disclosed herein may be further limited in the claims using consisting of or consisting essentially of language. When used in the claims, whether as filed or added per amendment, the transition term "consisting of" excludes any element, step, or ingredient not specified in the claims. The transition term "consisting essentially of" limits the scope of a claim to the specified materials or steps and those that do not materially affect the basic and novel characteristic(s). Embodiments of the present invention so claimed are inherently or expressly described and enabled herein.

Groupings of alternative embodiments, elements, or steps of the present invention are not to be construed as limitations. Each group member may be referred to and claimed individually or in any combination with other group members disclosed herein. It is anticipated that one or more members of a group may be included in, or deleted from, a group for reasons of convenience and/or patentability. When any such inclusion or deletion occurs, the specification is deemed to contain the group as modified thus fulfilling the written description of all Markush groups used in the appended claims.

All patents, patent publications, and other publications referenced and identified in the present specification are individually and expressly incorporated herein by reference in their entirety for the purpose of describing and disclosing, for example, the compositions and methodologies described in such publications that might be used in connection with the present invention. These publications are provided solely for their disclosure prior to the filing date of the present application. Nothing in this regard should be construed as an admission that the inventors are not entitled to antedate such disclosure by virtue of prior invention or for any other reason. All statements as to the date or representation as to the contents of these documents is based on the information available to the applicants and does not constitute any admission as to the correctness of the dates or contents of these documents.

In closing, it is to be understood that although aspects of the present specification are highlighted by referring to specific embodiments, one skilled in the art will readily appreciate that these disclosed embodiments are only illustrative of the principles of the subject matter disclosed herein. Therefore, it should be understood that the disclosed subject matter is in no way limited to a particular methodology, protocol, and/or reagent, etc., described herein. As such, various modifications or changes to or alternative configurations of the disclosed subject matter can be made in accordance with the teachings herein without departing from the spirit of the present specification. Lastly, the terminology used herein is for the purpose of describing particular embodiments only, and is not intended to limit the scope of the present invention, which is defined solely by the claims. Accordingly, the present invention is not limited to that precisely as shown and described.

TABLE 20

SEQUENCES

| Seq ID | sequence | name |
|---|---|---|
| 1 | DYIFSNYYIE | HCDR1; DLL3.2, DLL3.4 |
| 2 | DYTFSNYYIE | HCDR1; DLL3.1 |
| 3 | DYYMN | HCDR1, DLL3.9 |
| 4 | DYYVN | HCDR1; DLL3.8 |
| 5 | GFTFSNYGMH | HCDR1: DLL3.10, DLL3.27, DLL3.29, DLL3.30, DLL3.31, DLL3.32, DLL3.33, DLL3.38 |
| 6 | GFTFSSYGMH | HCDR1: DLL3.5, DLL3.12 DLL3.13, DLL3.14, DLL3.15, DLL3.16, DLL3.17 DLL3.18, DLL3.19. DLL3.20, DLL3.21, DLL3.22, DLL3.23, DLL3.24, DLL3.25, DLL3.26 |

TABLE 20-continued

SEQUENCES

| Seq ID | sequence | name |
|---|---|---|
| 7 | GFTFSSYGMH | HCDR1: DLL3.3, DLL3.11 |
| 8 | SAYYWN | HCDR1: DLL23.34, DLL3.35 |
| 9 | SYYWS | HCDR1: DDL3.28 |
| 10 | EILPGNGNTVYNEKFKD | HCDR2; DLL3.1 |
| 11 | EILPGTGNTVYNEKFKD | HCDR2: DLL3.2, DLL3.4 |
| 12 | IISPNDGGTNYNQKFKG | HCDR2; DLL3.8 |
| 13 | VINPDNGITTYNQKFKG | HCDR2; DLL3.9 |
| 14 | VINPYNDITIYNQKFQG | HCDR2: DLL3.3 |
| 15 | VISGSGSSKYYADSVKG | HCDR2; DLL3.11, DLL3.15, DLL3.18, DLL3.22 |
| 16 | VISHHGSSKYYADSVKG | HCDR2: DLL3.5, DLL3.10, DLL3.12, DLL3.14, DLL3.17, DLL3.19, DLL3.21, DLL3.23, DLL3.25, DLL3.26, DLL3.27, DLL3.31, DLL3.32, DLL3.33 |
| 17 | VISHHGSSKYYARSVKG | HCDR2: DLL3.29, DLL3.30, DLL3.36 |
| 18 | VISYDGSSKYYADSVKG | HCDR2; DLL3.13, DLL3.16, DLL3.20, DLL3.24 |
| 19 | YISDVGHNYYNPSLKN | HCDR2; DLL3.34 |
| 20 | YISDVGSNNYNPSLKN | HCDR2; DLL3.35 |
| 21 | YVYYSGTTNYNPSLKS | HCDR2; DLL3.28 |
| 22 | WGDYALFAN | HCDR3: DLL3.1, DLL3.2, DLL3.4 |

TABLE 20-continued

| Seq ID | sequence | name |
|---|---|---|
| 23 | DQVFAY | HCDR3; DLL3.8, DLL3.34, DLL3.35 |
| 24 | DWFFYLFDY | HCDR3; DLL3.5, DLL3.10, DLL3.11, DLL3.12, DLL3.13, DLL3.14, DLL3.15, DLL3.16, DLL3.17, DLL3.26, DLL3.27, DLL3.31 |
| 25 | DWFYFIFDY | HCDR3; DLL3.18, DLL3.19, DLL3.20, DLL3.21, DLL3.22, DLL3.23, DLL3.24, DLL3.25, DLL3.32, DLL3.33 |
| 26 | DWWELVFDY | HCDR3; DLL3.29, DLL3.20, DLL3.36 |
| 27 | EGVLYDGYYEGAY | HCDR3; DLL3.3 |
| 28 | GVWNYERSFDY | HCDR3; DLL3.9 |
| 29 | SIAVTGFYFDY | HCDR3; DLL3.28 |
| 30 | SASSSVSYMH | LCDR1; DLL3.35 |
| 31 | KASQNVGIAVA | LCDR1; DLL3.3 |
| 32 | KASQNVGTNVA | LCDR1; DLL3.1, DLL3.2, DLL3.4, DLL3.9, DLL3.28 |
| 33 | KSSQSLLHSDAKTFLY | LCDR1; DLL3.22, DLL3.23, DLL3.24, DLL3.25, DLL3.26, DLL3.27, DLL3.32, DLL3.33 |
| 34 | KSSQSLLHSDGKTFLY | LDCR1: DLL3.5, DLL3.10, DLL3.15, DLL3.16, DLL3.17, DLL3.29, |

TABLE 20-continued

| Seq ID | sequence | name |
|---|---|---|
| | | DLL3.30, DLL3.32, DLL3.36 |
| 35 | RASESVHSYGNSLIH | LDCR1; DLL3.34 |
| 36 | RSSKSLLHSNGITYLY | LCDR1; DLL3.8 |
| 37 | RSSQSLLHSDAKTFLD | LCDR1; DLL3.18, DLL3.19, DLL3.20, DLL3.21, |
| 38 | RSSQSLLHSDGKTFLD | LCDR1: DLL3.11, DLL3.12, DLL3.13, DLL3.14 |
| 39 | SASYRYS | LCDR2: DLL3.4, DLL3.28 |
| 40 | AASNRYT | LCDR2: DLL3.3 |
| 41 | DTSKLAS | LCDR2; DLL3.35 |
| 42 | EVSNRAS | LCDR2; DLL3.11, DLL3.12, DLL3.13, DLL3.14, DLL3.18, DLL3.19, DLL3.20, DLL3.21 |
| 43 | EVSNRFS | LCDR2: DLL3.5, DLL3.10, DLL3.15, DLL3.16, DLL3.17, DLL3.22, DLL3.23, DLL3.14, DLL3.25, DLL3.26, DLL3.27, DLL3.29, DLL3.30, DLL3.31, DLL3.32, DLL3.33, DLL3.36 |
| 44 | QMSNLAS | LCDR2; DLL3.8 |
| 45 | RASNLES | LCDR2; DLL3.34 |
| 46 | SASYRYS | LCDR2; DLL3.1, DLL3.2, DLL3.9 |
| 47 | QQYSTYPYT | LCDR3: DLL3.3 |

TABLE 20-continued

| Seq ID | sequence | name |
|---|---|---|
| 48 | AQNLELP | LCDR3: DLL3.8 |
| 49 | LQGERLPFT | LCDR3; DLL3.5, DLL3.10, DLL3.11, DLL3.12, DLL3.13, DLL3.14, DLL3.15, DLL3.16, DLL3.17, DLL3.26, DLL3.27, DLL3.31 |
| 50 | LQGIHLPFT | LCDR3; DLL3.29, DLL3.30, DLL3.36 |
| 51 | LQGRELPFT | LCDR3; DLL3.18, DLL3.19, DLL3.20, DLL3.21, DLL3.22, DLL3.23, DLL3.24, DLL3.25, DLL3.32, DLL3.33 |
| 52 | QQTNEDP | LCDR3; DLL3.34 |
| 53 | QQWSSNPLT | LCDR3; DLL3.35 |
| 54 | QQYNNYPLT | LCDR3; DLL3.4, DLL3.9, DLL3.28 |
| 55 | QQYNSYPFT | LCDR3; DLL3.1, DLL3.2 |
| 56 | EVQLLESGGGLVQPGGSLRLSCAASGFTFSSYGMHWVRQAPGK GLEWVAVISGSGSSKYYADSVKGRFTISRDNSKNTLYLQMNSLRA EDTAVYYCARDWFFYLFDYWGQGTLVTVSS | VH; DLL3.11, DLL3.15 |
| 57 | EVQLLESGGGLVQPGGSLRLSCAASGFTFSSYGMHWVRQAPGK GLEWVAVISGSGSSKYYADSVKGRFTISRDNSKNTLYLQMNSLRA EDTAVYYCARDWFYFIFDYWGQGTLVTVSS | VH: DLL3.18, DLL3.22 |
| 58 | EVQLLESGGGLVQPGGSLRLSCAASGFTFSSYGMHWVRQAPGK GLEWVAVISHHGSSKYYADSVKGRFTISRDNSKNTLYLQMNSLRA EDTAVYYCARDWFFYLFDYWGQGTLVTVSS | VH; DLL3.5, DLL3.12, DLL3.26 |
| 59 | EVQLLESGGGLVQPGGSLRLSCAASGFTFSSYGMHWVRQAPGK GLEWVAVISHHGSSKYYADSVKGRFTISRDNSKNTLYLQMNSLRA EDTAVYYCARDWFYFIFDYWGQGTLVTVSS | VH; DLL3.19, DLL3.23 |
| 60 | EVQLLESGGGLVQPGGSLRLSCAASGFTFSSYGMHWVRQAPGK GLEWVAVISYDGSSKYYADSVKGRFTISRDNSKNTLYLQMNSLRA EDTAVYYCARDWFFYLFDYWGQGTLVTVSS | VH; DLL3.13, DLL3.16, |
| 61 | EVQLLESGGGLVQPGGSLRLSCAASGFTFSSYGMHWVRQAPGK GLEWVAVISYDGSSKYYADSVKGRFTISRDNSKNTLYLQMNSLRA EDTAVYYCARDWFYFIFDYWGQGTLVTVSS | VH; DLL3.20, DLL3.24 |

TABLE 20-continued

SEQUENCES

| Seq ID | sequence | name |
|---|---|---|
| 62 | EVQLLESGGGLVQPGGSLRLSCAASGFTFSSYGMHWVRQAPGK GLEWVSVISHHGSSKYYADSVKGRFTISRDNSKNTLYLQMNSLRA EDTAVYYCAKDWFFYLFDYWGQGTLVTVSS | VH; DLL3.14, DLL3.17 |
| 63 | EVQLLESGGGLVQPGGSLRLSCAASGFTFSSYGMHWVRQAPGK GLEWVSVISHHGSSKYYADSVKGRFTISRDNSKNTLYLQMNSLRA EDTAVYYCAKDWFYFIFDYWGQGTLVTVSS | VH; DLL3.21, DLL3.25 |
| 64 | EVQLQQSGPVLVKPGASVKMSCKASGFTFTDYYMNWVKQSHGK SLEWIGVINPDNGITTYNQKFKGKATLTVDKSSSTAYMELNGLTSE DSAVYYCARGVWNYERSFDYWGQGTTLTVSS | VH; DLL3.9 |
| 65 | EVQLVESGGGLVQPGGSLRLSCAASGFTFSNYGMHWVRQAPGK GLEWVAVISHHGSSKYYADSVKGRYTISRDNSKNTLYLQMNSLRA EDTAVYYCARDWFFYLFDYWGQGTLVTVSS | VH DLL3.27 |
| 66 | QVQLQESGPGLVKPSETLSLTCTVSGGSISSYYWSWIRQPPGKGL EWIGYVYYSGTTNYNPSLKSRVTISVDTSKNQFSLKLSSVTAADTA VYYCASIAVTGFYFDYWGQGTLVTVSS | VH; DLL3.28 |
| 67 | QVQLQQSGPVLVKPGASVKMSCKASGYSFTDYYVNWVKQSHGK SLEWIGIISPNDGGTNYNQKFKGKATLTVDKSSSTAYMEVNSLTSE DSAVYYCARDDDLGWYFDVWGTGTTVTVSS | VH; DLL3.8 |
| 68 | QVQLVESGGGAVQPGRSLRLSCAASGFTFSNYGMHWVRQAPGK GLEWVAVISHHGSSKYYARSVKGRFTISRDNSKNTLYLEMNSLRA EDTAVYYCARDWWELVFDYWGQGTLVTVSS | VH DLL3.29, DLL3.30, DLL3.36 |
| 69 | QVQLVESGGGVVQPGRSLRLSCAASGFTFSNYGMHWVRQAPGK GLEWVAVISHHGSSKYYADSVKGRFTISRDNSKNTLYLQMNSLRA EDTAVYYCARDWFFYLFDYWGQGTLVTVSS | VH DLL3.10, DLL3.31 |
| 70 | QVQLVESGGGVVQPGRSLRLSCAASGFTFSNYGMHWVRQAPGK GLEWVAVISHHGSSKYYADSVKGRFTISRDNSKNTLYLQMNSLRA EDTAVYYCARDWFYFIFDYWGQGTLVTVSS | VH; DLL3.32, DLL3.33 |
| 71 | QVQLVQSGAEVKKPGASVKVSCKASDYTFSNYYIEWVRQAPGQG LEWMGEILPGNGNTVYNEKFKDRVTMTVDTSTSTAYMELRSLRSD DTAVYYCARWGDYALFANWGQGTLVTVSS | VH; DLL3.1 |
| 72 | QVQLVQSGAEVKKPGASVKVSCKASGYTFTDYFMNWVRQAPGQ GLEWMGVINPYNDITIYNQKFQGRVTMTVDRSTSTVYMELSSLRS EDTAVYYCAREGVLYDGYYEGAYWGQGTLVTVSS | VH; DLL3.3 |
| 73 | QVQLVQSGAEVKKPGASVKVSCKATDYIFSNYYIEWVRQAPGQL EWMGEILPGTGNTVYNEKFKDRVTMTVDTSTSTVYMELSSLRSED TAVYYCARWGDYALFANWGQGTLVTVSS | VH; DLL3.2, DLL3.4 |
| 74 | SDVQLQESGPGLVKPSQSLSLTCSVTGYSITSAYYWNWIRQFPGN KLEWMGYISDVGHNYYNPSLKNRISITRDTSKNQFFLKLNSVTPED TATYYCARDQVFAYWGQGTLVTVSA | VH DLL3.34 |
| 75 | SDVQLQESGPGLVKPSQSLSLTCSVTGYSITSAYYWNWIRQFPGN KLEWMGYISDVGSNNYNPSLKNRISITRDTFKNQFFLKLNSVTTED TATYFCTRDQVFAYWGQGTLVTVS | VH DLL3.35 |
| 76 | DIQLTQSPSFLSASVGDRVTITCKASQNVGIAVAWYQQKPGKAPKL LIYAASNRYTGVPSRFSGSGSGTEFTLTISSLQPEDFATYYCQQYS TYPYTFGQGTKLEIK | VL; DLL3.3 |
| 77 | DIQMTQSPSFLSASVGDRVTITCKASQNVGTNVAWYQQKPGKAPK PLIYSTSYRYSGVPSRFSGSGSGTEFTLTISSLQPEDFATYYCQQY NNYPLTFGGGTKVEIK | VL; DLL3.4 |
| 78 | DIQMTQSPSSLSASVGDRVTITCKSSQSLLHSDAKTFLYWYQQKP GKAPKLLIYEVSNRFSGVPSRFSGSGSGTDFTLTISSLQPEDFATY YCLQGERLPFTFGQGTKVEIK | VL; DLL3.26 |
| 78 | DIQMTQSPSSLSASVGDRVTITCKSSQSLLHSDAKTFLYWYQQKP GKAPKLLIYEVSNRFSGVPSRFSGSGSGTDFTLTISSLQPEDFATY YCLQGERLPFTFGQGTKVEIK | VL; DLL3.27 |

TABLE 20-continued

SEQUENCES

| Seq ID | sequence | name |
|---|---|---|
| 79 | DIQMTQSPSTLSASVGDRVTITCKASQNVGTNVAWYQQKPGKAPK ALIYSASYRYSGVPSRFSGSGSGTEFTLTISSLQPDDFATYYCQQY NSYPFTFGQGTKLEIK | VL; DLL3.1 |
| 79 | DIQMTQSPSTLSASVGDRVTITCKASQNVGTNVAWYQQKPGKAPK ALIYSASYRYSGVPSRFSGSGSGTEFTLTISSLQPDDFATYYCQQY NSYPFTFGQGTKLEIK | VL; DLL3.2 |
| 80 | DIVMTQAAFSNPVTVGTSASISCRSSKSLLHSNGITYLYWYLQKPG QSPQLLIYQMSNLASGVPDRFSSSGSGTDFTLRISRVEAEDVGVY YCAQNLELPWTFGGGTKLEIK | VL; DLL3.8 |
| 81 | DIVMTQSPKFMSTSVGDRVSVTCKASQNVGTNVAWYQQKPGQSP KALIYSASYRYSGVPDRFTGSGSGTDFTLTFSSVQSEDLAEYFCQ QYNNYPLTFGGGTKLEIK | VL; DLL3.9 |
| 82 | DIVMTQSPLSLPVTPGEPASISCKSSQSLLHSDAKTFLYWYLQKPG QSPQLLIYEVSNRFSGVPDRFSGSGSGTDFTLKISRVEAEDVGVYY CLQGRELPFTFGQGTKVEIK | VL; DLL3.22, DLL3.23, DLL3.24, DLL3.25 |
| 83 | DIVMTQSPLSLPVTPGEPASISCKSSQSLLHSDGKTFLYWYLQKPG QSPQLLIYEVSNRFSGVPDRFSGSGSGTDFTLKISRVEAEDVGVYY CLQGERLPFTFGQGTKVEIK | VL; DLL3.5, DLL3.15, DLL3.16, DLL3.17 |
| 84 | DIVMTQSPLSLPVTPGEPASISCRSSQSLLHSDAKTFLDWYLQKPG QSPQLLIYEVSNRASGVPDRFSGSGSGTDFTLKISRVEAEDVGVYY CLQGRELPFTFGQGTKVEIK | VL DLL3.18, DLL3.19, DLL3.20, DLL3.21 |
| 85 | DIVMTQSPLSLPVTPGEPASISCRSSQSLLHSDGKTFLDWYLQKPG QSPQLLIYEVSNRASGVPDRFSGSGSGTDFTLKISRVEAEDVGVYY CLQGERLPFTFGQGTKVEIK | VL; DLL3.11, DLL3.12, DLL3.13, DLL3.14 |
| 86 | DIVMTQTPLSLSVTPGQPASISCKSSQSLLHSDAKTFLYWYLQKPG QPPQLLIYEVSNRFSGVPDRFSGSGSGTDFTLKISRVEAEDVGVYY CLQGRELPFTFGPGTKVEIK | VL DLL3.32, DLL3.33 |
| 87 | DIVMTQTPLSLSVTPGQPASISCKSSQSLLHSDGKTFLYWYLQKPG QPPQLLIYEVSNRFSGVPDRFSGSGSGTDFTLKISRVEAEDVGVYY CLQGERLPFTFGPGTKVEIK | VL; DLL3.10, DLL3.31 |
| 88 | DIVMTQTPLSLSVTPGQPASISCKSSQSLLHSDGKTFLYWYLQKPG QPPQLLIYEVSNRFSGVPDRFSGSGSGTDFTLKISRVEAEDVGVYY CLQGIHLPFTFGPGTKVEIK | VL; DLL3.29, DLL3.30, DLL3.36 |
| 89 | DTVLTQSPASLAVSLGQRATISCRASESVHSYGNSLIHWYQQKPG QPPRLLIYRASNLESGIPARFSGSGSRTDFTLTINPVEADDVATYYC QQTNEDPLTFGAGTKLELK | VL; DLL3.34 |
| 90 | EIVLTQSPGTLSLSPGERVTLSCRASQRVNNNYLAWYQQRPGQAP RLLIYGASSRATGIPDRFSGSGSGTDFTLTISRLEPEDFAVYYCQQ YDRSPLTFGGGTKLEIK | VL; DLL3.28 |
| 91 | QIVLTQSPAIMSASPGEKVTMTCSASSSVSYMHWYQQKSGTSPKR WIYDTSKLASGVPARFSGSGSGTSYSLTISSMEAEDAATYYCQQW SSNPLTFGAGTKLELK | VL; DLL3.35 |
| 92 | GFTFSSFGMH | HCDR1; Muc17.7, Muc17.21, Muc17.22, Muc17.23, Muc17.24 |
| 93 | GYAFSDYWIN | HCDR1: Muc17.2 |
| 94 | GYEFSSHWMN | HCDR1; Muc17.1, Muc17.8, |

TABLE 20-continued

SEQUENCES

| Seq ID | sequence | name |
|---|---|---|
| | | Muc17.9, muc17.10, Muc17.11, Muc17.12, Muc17.13, Muc17.14, Muc17.25, Muc71.26, Muc17.27, Muc17.28, Muc17.29, Muc17.30, Muc17.31 |
| 95 | GYIFSNHWMN | HCDR1: Mcu17.3 |
| 96 | GYTFTSYWLN | HCDR1; Muc17.17, Muc17.42, Muc17.43, Muc17.44, Muc17.46, Muc17.47 |
| 97 | GYTFTSYWMN | HCDR1; Muc17.4, Muc17.5, Muc17.6, Muc17.15, Muc17.16, Muc17.18, Muc17.19, Muc17.20, Muc17.32, Muc17.33, Mcu17.34, Muc17.35, Muc17.36, Muc17.37, Muc17.38, Muc17.39, Muc17.40, Muc17.41, Muc17.45, Muc17.48, Muc17.49 |
| 98 | GYTFTSYWMN | HCDR1; Mcu17.31 |
| 99 | MIHPSDSESRLNQKFKD | HCDR2; Muc17.17. Muc17.39, Muc17.40, Muc17.41, Muc17.46, Muc17.47 |
| 100 | MIHPSDSETRLNQEFKD | HCDR2; Muc17.5, Muc17.20 |
| 101 | MIHPSDSETRLNQKFKD | HCDR2; Muc17.4, Muc17.15, Muc17.16, Muc17.18, Muc17.19, Mcu17.31, Muc17.33, Muc17.34, Muc17.35, Muc17.36, Muc17.37, Muc17.38, |

TABLE 20-continued

| Seq ID | sequence | name |
|---|---|---|
| | | Muc17.42, Muc17.43, Muc17.44, Muc17.45, Muc17.48, Muc17.49 |
| 102 | MIHPSDSETRLNQKFTD | HCDR2; Muc17.6 |
| 103 | QIYPGDGDINYNEKFRG | HCDR2; Muc17.1, Muc17.9, Muc17.10, Muc17.11, Muc17.12, Muc17.13, Muc17.14, Muc17.25, Muc17.26, Muc17.27, Muc17.28, Muc17.29, Muc17.30, Muc17.31 |
| 104 | QIYPGDGDINYNGKFRG | HCDR2; Muc17.3 |
| 105 | QVYPGDDDINYNGKFRG | HCDR2; Muc17.2 |
| 106 | YISSGSSTIYYADTVKG | HCDR2; Muc17.7, Muc17.21, Muc17.22, Muc17.23, Muc17.24 |
| 107 | HGNYVMDY | HCDR2; Muc17.8 |
| 108 | HGNYVMDY | HCDR3; Muc17.1, Muc17.2, Muc17.8, Muc17.9, Muc17.10, Muc17.11, Muc17.12, Muc17.13, Muc17.14, Muc17.25, Muc17.26, Muc17.27, Muc17.28, Muc17.29, Muc17.30, Muc17.31 |
| 109 | QGIITSVQEFAY | HCDR3; Muc17.4, Muc17.6, Muc17.15, Muc17.16, Muc17.17, Muc17.18, Muc17.19, Muc17.31, Muc17.32, Muc17.33, Muc17.34, Muc17.35, Muc17.36, Muc17.37, Muc17.38, |

TABLE 20-continued

| Seq ID | sequence | name |
|---|---|---|
| | | Muc17.39, Muc17.40, Muc17.41, Muc17.42, Muc17.43, Muc17.44, Muc17.45, Muc17.46, Muc17.48, Muc17.49 |
| 110 | QGVITSVQEFAY | HCDR3; Muc17.5, Muc17.20 |
| 111 | WGYYGSSYFAY | HCDR3; Muc17.7, Muc17.21, Muc17.22, Muc17.23, Muc17.24 |
| 112 | HGNYLMDY | HCDR3; Muc17.3 |
| 113 | SASSSLNYIY | LCDR1; Muc17.6 |
| 114 | SASSSVNYIF | LCDR1; Muc17.18, Muc17.19, Muc17.41, Muc17.44, Muc17.46 |
| 115 | SASSSVNYIY | LCDR1; Muc17.4, Muc17.5, Muc17.15, Muc17.16, Muc17.17, Muc17.31, Muc17.32, Muc17.33, Muc17.34, Muc17.35, Muc17.36, Muc17.37, Muc17.38, Muc17.39, Muc17.40, Muc17.41, Muc17.43, Muc17.45, Muc17.47, Muc17.48, Muc17.49 |
| 116 | SASSSVSYMF | LCDR1; Muc17.1, Muc17.2, Muc17.8, Muc17.9, Muc17.10, Muc17.11, Muc17.12, Muc17.13, Muc17.14, Muc17.25, Muc17.26, Muc17.27, Muc17.28, Muc17.29, Muc17.30, Muc17.31 |

TABLE 20-continued

| Seq ID | sequence | name |
|---|---|---|
| 117 | SVSSNVDYVF | LCDR1; Muc17.3 |
| 118 | KASEDIYNRLA | LCDR1; Muc17.7, Muc17.21, Muc17.22, Muc17.23, Muc17.24 |
| 119 | RTSNLAS | LCDR2; Muc17.1, Muc17.2, Muc17.4, Muc17.5, Muc17.6, Muc17.8, Muc17.9, Muc17.10, Muc17.11, Muc17.12, Muc17.13, Muc17.14, Muc17.15, Muc17.16, Muc17.17, Muc17.18, Muc17.19, Muc17.20, Muc17.25, Muc17.26, Muc17.27, Muc17.28, Muc17.29, Muc17.30, Muc17.31, Muc17.32, Muc17.33, Muc17.34, Muc17.36, Muc17.37, Muc17.38, Muc17.39, Muc17.40, Muc17.41, Muc17.42, Muc17.43, Muc17.44, Muc17.45, Muc17.46, Muc17.48, Muc17.49 |
| 121 | GATNLET | LCDR2; Muc17.7, Muc17.21, Muc17.22, Muc17.23, Muc17.24 |
| 122 | QQFHDYPRT | LCDR3; Muc17.1, Muc17.8, Muc17.9, Muc17.10, Muc17.11, Muc17.12, Muc17.13, Muc17.14, Muc17.25, Muc17.26, Muc17.27, Muc17.28, Muc17.29, Muc17.30, Muc17.31 |

TABLE 20-continued

SEQUENCES

| Seq ID | sequence | name |
|---|---|---|
| 123 | QQFHSYPRT | LCDR3; Muc17.2, Muc17.3 |
| 124 | QQFWRTPPT | LCDR3; Muc17.7, Muc17.21, Muc17.22, Muc17.23 |
| 125 | QQYHSYPLT | LCDR3; Muc17.4, Muc17.5, Muc17.6, Muc17.15, Muc17.16, Muc17.17, Muc17.18, Muc17.19, Muc17.20 Muc17.31, Muc17.32, Muc17.33, Muc17.34, Muc17.35, Muc17.36, Muc17.37, Muc17.38, Muc17.39, Muc17.40, Muc17.41, Muc17.42, Muc17.43, Muc17.44, Muc17.45, Muc17.47, Muc17.48, Muc17.49 |
| 126 | CQQFWRTPPT | LCDR3; Muc17.24 |
| 127 | EVQLVQSGAEVKKPGESLKISCKGSGYEFSSHWMNWVRQMPGK GLEWMGQIYPGDGDINYNEKFRGQVTISADKSISTAYLQWSSLKA SDTAMYYCARHGNYVMDYWGQGTLVTVSS | VH; Muc17.1, Muc17.8, Muc17.9, Muc17.10, Muc17.11, Muc17.12, Muc17.13, Muc17.14 |
| 128 | QVQLVQSGAEVKKP+E60:J60GSSVKVSCKASGYTFTSYWLNWV RQAPGQGLEWMGMIHPSDSESRLNQKFKDRVTITADKSTSTAYM ELSSLRSEDTAVYYCARQGIITSVQEFAYWGQGTLVTVSS | VH; Muc17.17 |
| 129 | QVQLVQSGAEVKKPGASVKVSCKASGYEFSSHWMNWVRQAPGQ GLEWMGQIYPGDGDINYNEKFRGRVTMTRDTSTSTVYMELSSLRS EDTAVYYCARHGNYVMDYWGQGTLVTVSS | VH; Muc17.29, Muc17.30, Muc17.31 |
| 130 | QVQLVQSGAEVKKPGASVKVSCKASGYTFTSYWMNWVRQAPGQ GLEWIGMIHPSDSETRLNQKFKDRVTLTVDKSSSTAYMELSSLRSE DTAVYYCARQGIITSVQEFAYWGQGTLVTVSS | VH; Muc17.45 |
| 131 | QVQLVQSGAEVKKPGASVKVSCKASGYTFTSYWMNWVRQAPGQ GLEWMGMIHPSDSETRLNQEFKDRVTMTRDTSTSTVYMELSSLR SEDTAVYYCARQGVITSVQEFAYWGQGTLVTVSS | VH; Muc17.5, Muc17.20 |
| 132 | QVQLVQSGAEVKKPGASVKVSCKASGYTFTSYWMNWVRQAPGQ GLEWMGMIHPSDSETRLNQKFKDRVTLTRDKSISTAYMELSRLRS DDTAVYYCARQGIITSVQEFAYWGQGTLVTVSS | VH; Muc17.37 |

TABLE 20-continued

| Seq ID | sequence | name |
|---|---|---|
| 133 | QVQLVQSGAEVKKPGASVKVSCKASGYTFTSYWMNWVRQAPGQGLEWMGMIHPSDSETRLNQKFKDRVTL TVDKSISTAYMELSRLRSDDTAVYYCARQGIITSVQEFAYWGQGTLVTVSS | VH Muc17.35 |
| 134 | QVQLVQSGAEVKKPGASVKVSCKASGYTFTSYWMNWVRQAPGQGLEWMGMIHPSDSETRLNQKFKDRVTLTVDTSISTAYMELSRLRSDDTAVYYCARQGIITSVQEFAYWGQGTLVTVSS | VH; Muc17.36 |
| 135 | QVQLVQSGAEVKKPGASVKVSCKASGYTFTSYWMNWVRQAPGQGLEWMGMIHPSDSETRLNQKFKDRVTMTRDTSISTAYMELSRLRSDDTAVYYCARQGIITSVQEFAYWGQGTLVTVSS | VH; Muc17.23, Muc17.33, Muc17.34 |
| 136 | QVQLVQSGAEVKKPGASVKVSCKASGYTFTSYWMNWVRQAPGQGLEWMGMIHPSDSETRLNQKFKDRVTMTRDTSTSTVYMELSSLRSEDTAVYYCARQGIITSVQEFAYWGQGTLVTVSS | VH; Muc17.31, Muc17.48, Muc17.49 |
| 137 | QVQLVQSGAEVKKPGASVKVSCKASGYTFTSYWMNWVRQAPGQGLEWMGMIHPSDSETRLNQKFKDRVTMTVDKSISTAYMELSRLRSDDTAVYYCARQGIITSVQEFAYWGQGTLVTVSS | VH; Muc17.38 |
| 138 | QVQLVQSGAEVKKPGASVKVSCKASGYTFTSYWMNWVRQAPGQGLEWMGMIHPSDSETRLNQKFTDRVTMTRDTSTSTVYMELSSLRSEDTAVYYCARQGIITSVQEFAYWGQGTLVTVSS | VH Muc17.6 |
| 139 | QVQLVQSGAEVKKPGSSVKVSCKASGYAFSDYWINWVRQAPGQGLEWMGQVYPGDDDINYNGKFRGRVTITADKSTSTAYMELSSLRSEDTAVYYCARHGNYVMDYWGQGTTVTVSS | VH Muc17.2 |
| 140 | QVQLVQSGAEVKKPGSSVKVSCKASGYEFSSHWMNWVRQAPGQGLEWMGQIYPGDGDINYNEKFRGRVTITADKSTSTA YMELSSLRSEDTAVYYCARHGNYVMDYWGQGTTVTVSS | Vh Muc17.25, Muc17.26, Muc17.27, Muc17.28 |
| 141 | QVQLVQSGAEVKKPGSSVKVSCKASGYIFSNHWMNWVRQAPGQGLEWMGQIYPGDGDINYNGKFRGRVTITADKSTSTAYMELSSLRSEDTAVYYCARHGNYLMDYWGQGTTVTVSS | VH; Muc17.3 |
| 142 | QVQLVQSGAEVKKPGSSVKVSCKASGYTFTSYWLNWVRQAPGQGLEWMGMIHPSDSESRLNQKFKDRVTITADKSTSTAYMELSSLRSEDTAVYYCARQGIITSVQEFAYWGQGTLVTVSS | VH; Mucc. 17.46, Muc17.47 |
| 143 | QVQLVQSGAEVKKPGSSVKVSCKASGYTFTSYWLNWVRQAPGQGLEWMGMIHPSDSETRLNQKFKDRVTITADKSTSTAYMELSSLRSEDTAVYYCARQGIITSVQEFAYWGQGTLVTVSS | VH; Muc17.42, Muc17.43, Muc17.44 |
| 144 | QVQLVQSGAEVKKPGSSVKVSCKASGYTFTSYWMNWVRQAPGQGLEWMGMIHPSDSESRLNQKFKDRVTITADKSTSTAYMELSSLRSEDTAVYYCARQGIITSVQEFAYWGQGTLVTVSS | VH; Muc17.39, Muc17.40, Muc17.41 |
| 145 | QVQLVQSGAEVKKPGSSVKVSCKASGYTFTSYWMNWVRQAPGQGLEWMGMIHPSDSETRLNQKFKDRVTITADKSTSTAYMELSSLRSEDTAVYYCARQGIITSVQEFAYWGQGTLVTVSS | VH; Muc17.4, Muc17.15, Muc17.16, Muc17.18, Muc17.19 |
| 146 | EVQLVESGGGLVQPGGSLRLSCAASGFTFSSFGMHWVRQAPGKGLEWVSYISSGSSTIYYADTVKGRFTISRDNAKNSLYLQMNSLRAEDTAVYYCARWGYYGSSYPAYWGQGTLVTVSS | VH; Muc17.7, Muc17.21, Muc17.22, Muc17.23, Muc17.24 |
| 147 | DIQMTQSPSSLSASVGDRVTITCKASEDIYNRLAWYQQKPGKAPKLLIYGATNLETGVPSRFSGSGSGTDFTFTISSLQPEDIATYYCQQFWRTPPTFGGGTKVEIK | VL; Muc17.24 |
| 148 | DIQMTQSPSSLSASVGDRVTITCKASEDIYNRLAWYQQKPGKAPKPLISGATNLETGVPSRFSGSGSGKDYTLTISSLQPEDIATYYCQQFWRTPPTFGGGTKVEIK | VL; Muc17.21 |

TABLE 20-continued

| Seq ID | sequence | name |
|---|---|---|
| 149 | DIQMTQSPSSLSASVGDRVTITCKASEDIYNRLAWYQQKPGKAPK PLISGATNLETGVPSRFSGSGSGTDFTFTISSLQPEDIATYYCQQF WRTPPTFGGGTKVEIK | VL; Muc17.7 |
| 150 | DIQMTQSPSSLSASVGDRVTITCKASEDIYNRLAWYQQKPGKAPK PLIYGATNLETGVPSRFSGSGSGTDFTFTISSLQPEDIATYYCQQF WRTPPTFGGGTKVEIK | VL; Muc17.22 |
| 151 | EIVLTQSPATLSLSPGERATLSCSASSSVNYIFWYQQKPGQAPRLLI YRTSNLASGIPARFSGSGSGTDFTLTISSLEPEDFAVYYCQQYHSY PLTFGGGTKVEIK | VL; Muc17.18 |
| 152 | EIVLTQSPATLSLSPGERATLSCSASSSVNYIYWYQQKPGQAPRLLI YRTSNLASGIPARFSGSGSGTDFTLTISSLEPEDFAVYYCQQYHSY PLTFGGGTKVEIK | VL; Muc17.16, Muc17.17, Muc17.34, Muc17.39, Muc17.42, Muc17.49 |
| 153 | EIVLTQSPATLSLSPGERATLSCSASSSVSYMFWYQQKPGQAPRL LIYRTSNLASGIPARFSGSGSGTDFTLTISSLEPEDFAVYYCQQFHD YPRTFGGGTKVEIK | VL; Muc17.8, Muc17.27, Muc17.31 |
| 154 | EIVLTQSPATLSLSPGERATLSCSASSSVSYMFWYQQKPGQAPRL LIYRTSNLASGIPARFSGSGSGTDFTLTISSLEPEDFAVYYCQQFHS YPRTFGGGTKVEIK | VL; Muc17.2 |
| 155 | EIVLTQSPATLSLSPGERATLSCSASSSVSYMFWYQQKPGQAPRP WIYRTSNLASGIPPRFSGSGSGTDYTLTISSLEPEDFAVYYCQQFH DYPRTFGGGTKVEIK | VL; Muc17.28 |
| 156 | EIVLTQSPATLSLSPGERATLSCSVSSNVDYVFWYQQKPGQAPRL LIYRTSNLATGIPARFSGSGSGTDFTLTISSLEPEDFAVYYCQQFHS YPRTFGGGTKVEIK | VL; Muc17.3 |
| 157 | EIVLTQSPATLSVSPGERATLSCSASSSVNYIYWYQQKPGQAPRP WIYRTSNLASGIPARFSGSGSGTEYTLTISSLQSEDFAVYYCQQYH SYPLTFGGGTKVEIK | VL; Muc17.20 |
| 158 | EIVMTQSPATLSVSPGERATLSCSASSSLNYIYWYQQKPGQAPRLL IYRTSNLASGIPARFSGSGSGTEFTLTISSLQSEDFAVYYCQQYHS YPLTFGGGTKVEIK | VL; Muc17.6 |
| 159 | EIVMTQSPATLSVSPGERATLSCSASSSVNYIYWYQQKPGQAPRL LIYRTSNLASGIPARFSGSGSGTEFTLTISSLQSEDFAVYYCQQYHS YPLTFGGGTKVEIK | VL; Muc17.5, Muc17.15, Muc17.33, Muc17.45, Muc17.48 |
| 160 | EIVMTQSPATLSVSPGERATLSCSASSSVSYMFWYQQKPGQAPRL LIYRTSNLASGIPARFSGSGSGTEFTLTISSLQSEDFAVYYCQQFHD YPRTFGGGTKVEIK | VL; Muc17.14, Muc17.26, Muc17.30 |
| 161 | IQLTQSPSFLSASVGDRVTITCSASSSVSYMFWYQQKPGKAPKLLI YRTSNLASGVPPRFSGSGSGTEFTLTISSLQPEDFATYYCQQFHD YPRTFGGGTKVEIK | VL; Muc17.13 |
| 162 | IQLTQSPSFLSASVGDRVTITCSASSSVSYMFWYQQKPGKAPKLLI YRTSNLASGVPPRFSGSGSGTEYTLTISSLQPEDFATYYCQQFHD YPRTFGGGTKVEIKR | VL; Muc17.11 |
| 163 | IQLTQSPSFLSASVGDRVTITCSASSSVSYMFWYQQKPGKAPKLLI YRTSNLASGVPSRFSGSGSGTEFTLTISSLQPEDFATYYCQQFHD YPRTFGGGTKVEIK | VL; Muc17.9, Muc17.25, Muc17.29 |
| 164 | IQLTQSPSFLSASVGDRVTITCSASSSVSYMFWYQQKPGKAPKLLI YRTSNLASGVPSRFSGSGSGTEYTLTISSLQPEDFATYYCQQFHD YPRTFGGGTKVEIK | VL; Muc17.10 |

TABLE 20-continued

| Seq ID | sequence | name |
|---|---|---|
| 165 | IQLTQSPSFLSASVGDRVTITCSASSSVSYMFWYQQKPGKAPKPW IYRTSNLASGVPPRFSGSGSGTEYTLTISSLQPEDFATYYCQQFHD YPRTFGGGTKVEIK | VL; Muc17.12 |
| 166 | IQLTQSPSFLSASVGDRVTITCSASSSVSYMFWYQQKPGKAPKPW IYRTSNLASGVPSRFSGSGSGTEFTLTISSLQPEDFATYYCQQFHD YPRTFGGGTKVEIK | VL; Muc17.1 |
| 167 | IQMTQSPSSLSASVGDRVTITCSASSSVNYIFWYQQKPGKAPKLLI YRTSNLASGVPSRFSGSGSGTDFTLTISSLQPEDFATYYCQQYHS YPLTFGGGTKVEIK | VL; Muc17.19, Muc17.41, Muc17.44, Muc17.46 |
| 168 | IQMTQSPSSLSASVGDRVTITCSASSSVNYIYWYQQKPGKAPKLLI YRTSNLASGVPSRFSGSGSGTDFTLTISSLQPEDFATYYCQQYHS YPLTFGGGTKVEIK | VL; Muc17.4, Muc17.31, Muc17.32, Muc17.35, Muc17.36, Muc17.387, Muc17.38, Muc17.40, Muc17.43, Muc17.47 |
| 169 | DIQMTQSPSSLSASVGDRVTITCKASEDIYNRLAWYQQKPGKAPKL LIYGATNLETGVPSRFSGSGSGKDYTLTISSLQPEDIATYYCQQFW RTPPTFGGGTKVEIK | VL; Muc17.23 |
| 170 | GFTFSSFGMH | HCDR1; CLDN182.3, CLDN182.&, CLDN182.12, CLDN182.13 |
| 171 | GYAFNNYWMN | HCDR1; CLDN182.5 |
| 172 | GYAFSSYWMN | HCDR1; CLDN182.6, CLDN182.9, CLDN182.15, CLDN182.16 |
| 173 | GYTFTNFGIT | HCDR1; CLDN182.4, CLDN182.8, CLDN182.10, CLDN18.11 |
| 174 | GYTFTNSGMN | HCDR1; CLDN182.2, CLDN182.14, CLDN182.17 |
| 175 | GYTFTNYGMN | HCDR1; CLDN182.1 |
| 176 | EIYPSSGNTFYNEKFKG | HCDR2; CLDN182.4, CLDN182.8, CLDN182.10, CLDN182.11 |
| 177 | QISPGNGNSNFNGKFKG | HCDR2; CLDN182.5 |
| 178 | QIYPGNGNSNFNGKFKA | HCDR2; CLDN182.6, CLDN182.9, CLDN182.15, CLDN182.16 |

TABLE 20-continued

SEQUENCES

| Seq ID | sequence | name |
|---|---|---|
| 179 | WINTNTGEPTFAEEFRG | HCDR2; CLDN182.2, CLDN182.14, CLDN182.17 |
| 180 | WINTNTGEPTYAEEFKG | HCDR2; CLDN182.1 |
| 181 | YISSGNSAIYYADTVNG | HCDR2; CLDN182.3, CLDN182.7, CLDN182.12, CLDN182.13 |
| 182 | GGGPLRSRYFDY | HCDR3; CLDN182.4, CDLN182.8, CLDN182.10, CLDN182.11 |
| 183 | GGRFGNAMDY | HCDR3; CLDN182.6, CLDN182.9, CLDN182.15, CLDN182.16 |
| 184 | GGRYGNAMDY | HCDR3; CLDN182.5 |
| 185 | LRYGNSFDY | HCDR3; CLDN182.3, CLDN182.7, CLDN182.12, CLDN182.13 |
| 186 | YFYGNSFVY | HCDR3; CLDN182.1 |
| 187 | YYYGNSFAY | HCDR3; CLDN182.2, CLDN182.14, CLDN182.17 |
| 188 | KSSQSLLNSGNQKAJYLT | LCDR1; CLDN182.1, CLDN182.2, CLDN182.3, CLDN182.6, CLDN182.7, CLDN182.9, CLDN182.12, CLDN182.13, CLDN182.14, CLDN182.15, CLDN182.16, CLDN182.17 |
| 189 | KSSQSLLNSGNQRNYLT | LCDR1; CLDN182.5 |
| 190 | RSSQSLFSSGNQKNYLT | LCDR1; CLDN182.4, CLDN182.8, CLDN182.10, CLDN182.11 |
| 191 | WVASTRES | LCDR2; CLDN182.1, CLDN182.2, CLDN182.3, CLDN182.4, CLND182.5, CLDN182.6, CLDN182.7, CLDN182.8, |

TABLE 20-continued

| Seq ID | sequence | name |
|---|---|---|
| | | CLDN182.9, CLDN182.10, CLDN182.11, CLDN182.12, CLDN182.13, CLDN182.14, CLDN182.15, CLDN182.16, CLDN182.17 |
| 192 | QNAYFYPYT | LCDR3; CLDN182.5, CLDN182.6, CLND182.9, CLDN182.15, CLDN182.16 |
| 193 | QNDYYYPLT | LCDR3; CLDN182.4, CLDN182.8, CLND182.10, CLDN182.11 |
| 194 | QNNYFYPLT | LCDR3; CLDN182.2, CLND182.14, CLND182.17 |
| 195 | QNNYNFPLT | LCDR3; CLDN182.1 |
| 196 | QNNYYYPLT | LCDR3; CLDN182.3, CLND182.7, CLND182.12, CLND182.13 |
| 197 | EVQLVESGGGLVQPGGSLRLSCAASGFTFSSFGMHVWRQAPGK GLEVWAYISSGNSAIYYADTVNGRFTISRDNPKNTLYLQMNSLRAE DTAVYYCARLRYGNSFDYWGQGTLVTVSS | VH; CLDN182.12, CLND182.13 |
| 198 | EVQLVESGGGLVQPGGSLRLSCAASGFTFSSFGMHVWRQAPGK GLEVWSYISSGNSAIYYADTVNGRFTISRDNAKNSLYLQMNSLRAE DTAVYYCARLRYGNSFDYWGQGTLVTVSS | VH; CLDN182.3, CLDN182.7 |
| 199 | QIQLVQSGAEVKKPGASVKVSCKASGYTFTNSGMNVWRQAPGQ GLEWMGWINTNTGEPTFAEEFRGRVTFTLDTSASTAYMELSRLRS DDTAVYYCARYYYGNSFAYWGQGTLVTVSS | VH; CLDN182.14 |
| 200 | QVQLVQSGAEVKKPGASVKVSCKASGYTFTNFGITVWRQAPGQG LEWIGEIYPSSGNTFYNEKFKGRVTLTADKSSSAAYMELRSLRSD DTAVYYCARGGGPLRSRYFDYWGQGTLVTVSS | VH; CLDN182.10, CLND182.11 |
| 201 | QVQLVQSGAEVKKPGASVKVSCKASGYTFTNFGITVWRQAPGQG LEWMGEIYPSSGNTFYNEKFKGRVTMTTDTSTSTAYMELRSLRSD DTAVYYCARGGGPLRSRYFDYWGQGTLVTVSS | VH; CLDN182.4, CLND182.8 |
| 202 | QVQLVQSGAEVKKPGASVKVSCKASGYTFTNSGMNVWRQAPGQ GLEWMGWINTNTGEPTFAEEFRGRVTMTRDTSISTAYMELSRLRS DDTAVYYCARYYYGNSFAYWGQGTLVTVSS | VH CLND182.2, CLND182.17 |
| 203 | QVQLVQSGAEVKKPGASVKVSCKASGYTFTNYGMNVWRQAPGQ GLEWMGWINTNTGEPTYAEEFKGRVTMTRDTSISTAYMELSRLRS DDTAVYYCARYFYGNSFVYWGQGTLVTVSS | VH; CLDN182.1 |
| 204 | QVQLVQSGAEVKKPGSSVKVSCKASGYAFNNYWMNVWRQAPGQ GLEWMGQISPGNGNSNFNGKFKGRVTITADKSTSTAYMELSSLRS EDTAVYYCARGGRYGNAMDYWGQGTTVTVSS | VH; CLND182.5 |
| 205 | QVQLVQSGAEVKKPGSSVKVSCKASGYAFSSYWMNVWRQAPGQ GLEWIGQIYPGNGNSNFNGKFKARVTLTADKSSSTAYMELSSLRS EDTAVYYCARGGRFGNAMDYWGQTTVTVSS | VH; CLND182.15, CLND182.16 |
| 206 | QVQLVQSGAEVKKPGSSVKVSCKASGYAFSSYWMNVWRQAPGQ GLEWMGQIYPGNGNSNFNGKFKARVTITADKSTSTAYMELSSLRS EDTAVYYCARGGRFGNAMDYWGQGTTVTVSS | VH; CLDN182.6, CLDN182.9 |

TABLE 20-continued

SEQUENCES

| Seq ID | sequence | name |
|---|---|---|
| 207 | DIVMTQSPDSLAVSLGERATINCKSSQSLLNSGNQKNYLTWYQQK PGQPPKLLIFWASTRESGVPDRFSGSGSGTDFTLTISSLQAEDVAV YYCQNNYYYPLTFGGGTKVEIK | VL; CLND182.7, CLND182.13 |
| 206 | DIVMTQSPDSLAVSLGERATINCKSSQSLLNSGNQKNYLTWYQQK PGQPPKLLIYWASTRESGVPDRFSGSGSGTDFTLTISSLQAEDVA VYYCQNAYFYPYTFGGGTKVEIK | VL; CLDN182.6, CLND182.15 |
| 207 | DIVMTQSPDSLAVSLGERATINCKSSQSLLNSGNQKNYLTWYQQK PGQPPKLLIYWASTRESGVPDRFSGSGSGTDFTLTISSLQAEDVA VYYCQNNYFYPLTFGGGTKVEIK | VL; CLND182.2, CLND182.14 CLND182.17 |
| 208 | DIVMTQSPDSLAVSLGERATINCKSSQSLLNSGNQKNYLTWYQQK PGQPPKLLIYWASTRESGVPDRFSGSGSGTDFTLTISSLQAEDVAV YYCQNNYNFPLTFGGGTKVEIK | VL; CLND182.1 |
| 209 | DIVMTQSPDSLAVSLGERATINCKSSQSLLNSGNQKNYLTWYQQK PGQPPKLLIYWASTRESGVPDRFSGSGSGTDFTLTISSLQAEDVA VYYCQNNYYYPLTFGGGTKVEIK | VL; CLDN182.3, CLND182.12 |
| 210 | DIVMTQSPDSLAVSLGERATINCKSSQSLLNSGNQRNYLTWYQQK PGQPPKLLIYWASTRESGVPDRFSGSGSGTDFTLTISSLQAEDVA VYYCQNAYFYPYTFGGGTKVEIK | VL; CLND182.5 |
| 211 | DIVMTQSPDSLAVSLGERATINCRSSQSLFSSGNQKNYLTWYQQK PGQPPKLLIYWASTRESGVPDRFSGSGSGADFTLTISSLQAEDVAV YYCQNDYYYPLTFGGGTKVEIK | VL; CLDN182.8, CLND182.11 |
| 212 | DIVMTQSPDSLAVSLGERATINCRSSQSLFSSGNQKNYLTWYQQK PGQPPKLLIYWASTRESGVPDRFSGSGSGTDFTLTISSLQAEDVA VYYCQNDYYYPLTFGGGTKVEIK | VL; CLND812.4, CLND182.10 |
| 213 | DIVMTQSPDSLAVSLGERATMNCKSSQSLLNSGNQKNYLTWYQQ KPGQPPKLLIYWASTRESGVPDRFSGSGSGTDFTLTISSLQAEDVA VYYCQNAYFYPYTFGGGTKVEIK | VL; CLND182.9, CLND182.16 |
| 214 | SGGGGS | 1xG4S |
| 215 | GGGGSGGGGSGGGGS | 3xG4S |
| 216 | GKPGSGKPGSGKPGSGKPGS | CL |
| 217 | ASTKGPSVFPLAPSSKSTSGGTAALGCLVKDYFPEPVTVSWNSGA LTSGVHTFPAVLQSSGLYSLSSVVTVPSSSLGTQTYICNVNHKPSN TKVDKRVEPKSCDKTHTCPPCPAPELLGGPSVFLFPPKPKDTLMIS RTPEVTCVVVDVSHEDPEVKFNWYVDGVEVHNAKTKPREEQYNS TYRVVSVLTVLHQDWLNGKEYKCKVSNKALPAPIEKTISKAKGQPR EPQVYTLPPSRDELTKNQVSLTCLVKGFYPSDIAVEWESNGQPEN NYKTTPPVLDSDGSFFLYSKLTVDKSRWQQGNVFSCSVMHEALH NHYTQKSLSLSPGK | CH1-3 IgG1 |
| 218 | ASTKGPSVFPLAPSSKSTSGGTAALGCLVKDYFPEPVTVSWNSGA LTSGVHTFPAVLQSSGLYSLSSVVTVPSSSLGTQTYICNVNHKPSN TKVDKRVEPKSCDKTHTCPPCPAPELLGGPSVFLFPPKPKDTLMIS RTPEVTCVVVDVSHEDPEVKFNWYVDGVEVHNAKTKPREEQYAS TYRVVSVLTVLHQDWLNGKEYKCKVSNKALPAPIEKTISKAKGQPR EPQVYTLPPSRDELTKNQVSLTCLVKGFYPSDIAVEWESNGQPEN NYKTTPPVLDSDGSFFLYSKLTVDKSRWQQGNVFSCSVMHEALH NHYTQKSLSLSPGK | CH1-3 IgG1 (N297A) |
| 219 | ASTKGPSVFPLAPSSKSTSGGTAALGCLVKDYFPEPVTVSWNSGA LTSGVHTFPAVLQSSGLYSLSSVVTVPSSSLGTQTYICNVNHKPSN TKVDKRVEPKSCDKTHTCPPCPAPEFEGGPSVFLFPPKPKDTLMIS RTPEVTCVVVDVSHEDPEVKFNWYVDGVEVHNAKTKPREEQYNS TYRVVSVLTVLHQDWLNGKEYKCKVSNKALPASIEKTISKAKGQPR EPQVYTLPPSRDELTKNQVSLTCLVKGFYPSDIAVEWESNGQPEN NYKTTPPVLDSDGSFFLYSKLTVDKSRWQQGNVFSCSVMHEALH NHYTQKSLSLSPGK | CH1-3 IgG1 (L234F/L235E/P331S) |
| 220 | ASTKGPSVFPLAPSSKSTSGGTAALGCLVKDYFPEPVTVSWNSGA LTSGVHTFPAVLQSSGLYSLSSVVTVPSSSLGTQTYICNVNHKPSN TKVDKRVEPKSCDKTHTCPPCPAPELLGGPSVFLFPPKPKDTLMIS RTPEVTCVVVDVSHEDPEVKFNWYVDGVEVHNAKTKPREEQYNS TYRVVSVLTVLHQDWLNGKEYKCKVSNKALPAPIEKTISKAKGQPR | CH1-3 IgG1 (Y349C/K370E/K409D/K439E) |

TABLE 20-continued

SEQUENCES

| Seq ID | sequence | name |
|---|---|---|
| | EPQVCTLPPSRDELTKNQVSLTCLVEGFYPSDIAVEWESNGQPEN<br>NYKTTPPVLDSDGSFFLYSDLTVDKSRWQQGNVFSCSVMHEALH<br>NHYTQESLSLSPGK | |
| 221 | ASTKGPSVFPLAPSSKSTSGGTAALGCLVKDYFPEPVTVSWNSGA<br>LTSGVHTFPAVLQSSGLYSLSSVVTVPSSSLGTQTYICNVNHKPSN<br>TKVDKRVEPKSCDKTHTCPPCPAPELLGGPSVFLFPPKPKDTLMIS<br>RTPEVTCVVVDVSHEDPEVKFNWYVDGVEVHNAKTKPREEQYNS<br>TYRVVSVLTVLHQDWLNGKEYKCKVSNKALPAPIEKTISKAKGQPR<br>EPQVYTLPPCRKKLTKNQVSLTCLVKGFYPSDIAVEWESNGQPEN<br>NYKTTPPVLKSDGSFFLYSKLTVDKSRWQQGNVFSCSVMHEALH<br>NHYTQKSLSLSPGK | CH1-3 IgG1<br>(S354C/<br>D356K/<br>E357K/<br>D399K) |
| 222 | ASTKGPSVFPLAPSSKSTSGGTAALGCLVKDYFPEPVTVSWNSGA<br>LTSGVHTFPAVLQSSGLYSLSSVVTVPSSSLGTQTYICNVNHKPSN<br>TKVDKRVEPKSCDKTHTCPPCPAPELLGGPSVFLFPPKPKDTLMIS<br>RTPEVTCVVVDVSHEDPEVKFNWYVDGVEVHNAKTKPREEQYNS<br>TYRVVSVLTVLHQDWLNGKEYKCKVSNKALPAPIEKTISKAKGQPR<br>EPQVYTLPPSRDELTKNQVSLWCLVKGFYPSDIAVEWESNGQPEN<br>NYKTTPPVLDSDGSFFLYSKLTVDKSRWQQGNVFSCSVMHEALH<br>NHYTQKSLSLSPGK | CH1-3 IgG1<br>(S354C/T366W) |
| 223 | ASTKGPSVFPLAPSSKSTSGGTAALGCLVKDYFPEPVTVSWNSGA<br>LTSGVHTFPAVLQSSGLYSLSSVVTVPSSSLGTQTYICNVNHKPSN<br>TKVDKRVEPKSCDKTHTCPPCPAPELLGGPSVFLFPPKPKDTLMIS<br>RTPEVTCVVVDVSHEDPEVKFNWYVDGVEVHNAKTKPREEQYNS<br>TYRVVSVLTVLHQDWLNGKEYKCKVSNKALPAPIEKTISKAKGQPR<br>EPQVYTLPPSRDELTKNQVSLSCAVKGFYPSDIAVEWESNGQPEN<br>NYKTTPPVLDSDGSFFLVSKLTVDKSRWQQGNVFSCSVMHEALH<br>NHYTQKSLSLSPGK | CH1-3 IgG1<br>(Y349C/<br>T366S/<br>L368A/<br>Y407V) |
| 224 | ASTKGPSVFPLAPSSKSTSGGTAALGCLVKDYFPEPVTVSWNSGA<br>LTSGVHTFPAVLQSSGLYSLSSVVTVPSSSLGTQTYICNVNHKPSN<br>TKVDKRVEPKSCDKTHTCPPCPAPEFEGGPSVFLFPPKPKDTLMIS<br>RTPEVTCVVVDVSHEDPEVKFNWYVDGVEVHNAKTKPREEQYNS<br>TYRVVSVLTVLHQDWLNGKEYKCKVSNKALPASIEKTISKAKGQPR<br>EPQVCTLPPSRDELTKNQVSLTCLVEGFYPSDIAVEWESNGQPEN<br>NYKTTPPVLDSDGSFFLYSDLTVDKSRWQQGNVFSCSVMHEALH<br>NHYTQESLSLSPGK | CH1-3 IgG1<br>(L234F/L23<br>5E/P331S/<br>Y349C/K37<br>0E/K409D/K<br>439E) |
| 225 | ASTKGPSVFPLAPSSKSTSGGTAALGCLVKDYFPEPVTVSWNSGA<br>LTSGVHTFPAVLQSSGLYSLSSVVTVPSSSLGTQTYICNVNHKPSN<br>TKVDKRVEPKSCDKTHTCPPCPAPEFEGGPSVFLFPPKPKDTLMIS<br>RTPEVTCVVVDVSHEDPEVKFNWYVDGVEVHNAKTKPREEQYNS<br>TYRVVSVLTVLHQDWLNGKEYKCKVSNKALPASIEKTISKAKGQPR<br>EPQVYTLPPCRKKLTKNQVSLTCLVKGFYPSDIAVEWESNGQPEN<br>NYKTTPPVLKSDGSFFLYSKLTVDKSRWQQGNVFSCSVMHEALH<br>NHYTQKSLSLSPGK | CH1-3 IgG1<br>(L234F/L23<br>5E/P331S/<br>S354C/<br>D356K/<br>E357K/<br>0399K) |
| 226 | ASTKGPSVFPLAPSSKSTSGGTAALGCLVKDYFPEPVTVSWNSGA<br>LTSGVHTFPAVLQSSGLYSLSSVVTVPSSSLGTQTYICNVNHKPSN<br>TKVDKRVEPKSCDKTHTCPPCPAPEFEGGPSVFLFPPKPKDTLMIS<br>RTPEVTCVVVDVSHEDPEVKFNWYVDGVEVHNAKTKPREEQYNS<br>TYRVVSVLTVLHQDWLNGKEYKCKVSNKALPASIEKTISKAKGQPR<br>EPQVYTLPPSRDELTKNQVSLWCLVKGFYPSDIAVEWESNGQPEN<br>NYKTTPPVLDSDGSFFLYSKLTVDKSRWQQGNVFSCSVMHEALH<br>NHYTQKSLSLSPGK | CH1-3 IgG1<br>(L234F/L23<br>5E/P331S/<br>S354C/T36<br>6W) |
| 227 | ASTKGPSVFPLAPSSKSTSGGTAALGCLVKDYFPEPVTVSWNSGA<br>LTSGVHTFPAVLQSSGLYSLSSVVTVPSSSLGTQTYICNVNHKPSN<br>TKVDKRVEPKSCDKTHTCPPCPAPEFEGGPSVFLFPPKPKDTLMIS<br>RTPEVTCVVVDVSHEDPEVKFNWYVDGVEVHNAKTKPREEQYNS<br>TYRVVSVLTVLHQDWLNGKEYKCKVSNKALPASIEKTISKAKGQPR<br>EPQVYTLPPSRDELTKNQVSLSCAVKGFYPSDIAVEWESNGQPEN<br>NYKTTPPVLDSDGSFFLVSKLTVDKSRWQQGNVFSCSVMHEALH<br>NHYTQKSLSLSPGK | CH1-3 IgG1<br>(L234F/L23<br>5E/P331S/<br>Y349C/<br>T366S/<br>L368A/<br>Y407V) |
| 228 | ASTKGPSVFPLAPSSKSTSGGTAALGCLVKDYFPEPVTVSWNSGA<br>LTSGVHTFPAVLQSSGLYSLSSVVTVPSSSLGTQTYICNVNHKPSN<br>TKVDKRVEPKSCDKTHTCPPCPAPELLGGPSVFLFPPKPKDTLMIS<br>RTPEVTCVVVDVSHEDPEVKFNWYVDGVEVHNAKTKPREEQYAS<br>TYRVVSVLTVLHQDWLNGKEYKCKVSNKALPAPIEKTISKAKGQPR<br>EPQVCTLPPSRDELTKNQVSLTCLVEGFYPSDIAVEWESNGQPEN<br>NYKTTPPVLDSDGSFFLYSDLTVDKSRWQQGNVFSCSVMHEALH<br>NHYTQESLSLSPGK | CH1-3 IgG1<br>(N297A/<br>Y349C/K37<br>0E/K409D/K<br>439E) |

TABLE 20-continued

SEQUENCES

| Seq ID | sequence | name |
|---|---|---|
| 229 | ASTKGPSVFPLAPSSKSTSGGTAALGCLVKDYFPEPVTVSWNSGA LTSGVHTFPAVLQSSGLYSLSSVVTVPSSSLGTQTYICNVNHKPSN TKVDKRVEPKSCDKTHTCPPCPAPELLGGPSVFLFPPKPKDTLMIS RTPEVTCVVVDVSHEDPEVKFNWYVDGVEVHNAKTKPREEQYAS TYRVVSVLTVLHQDWLNGKEYKCKVSNKALPAPIEKTISKAKGQPR EPQVYTLPPCRKKLTKNQVSLTCLVKGFYPSDIAVEWESNGQPEN NYKTTPPVLKSDGSFFLYSKLTVDKSRWQQGNVFSCSVMHEALH NHYTQKSLSLSPGK | CH1-3 IgG1 (N297A/ S354C/ D356K/ E357K/ 0399K) |
| 230 | ASTKGPSVFPLAPSSKSTSGGTAALGCLVKDYFPEPVTVSWNSGA LTSGVHTFPAVLQSSGLYSLSSVVTVPSSSLGTQTYICNVNHKPSN TKVDKRVEPKSCDKTHTCPPCPAPELLGGPSVFLFPPKPKDTLMIS RTPEVTCVVVDVSHEDPEVKFNWYVDGVEVHNAKTKPREEQYAS TYRVVSVLTVLHQDWLNGKEYKCKVSNKALPAPIEKTISKAKGQPR EPQVYTLPPSRDELTKNQVSLWCLVKGFYPSDIAVEWESNGQPEN NYKTTPPVLDSDGSFFLYSKLTVDKSRWQQGNVFSCSVMHEALH NHYTQKSLSLSPGK | CH1-3 IgG1 (N297A/ S354C/T36 6W) |
| 231 | ASTKGPSVFPLAPSSKSTSGGTAALGCLVKDYFPEPVTVSWNSGA LTSGVHTFPAVLQSSGLYSLSSVVTVPSSSLGTQTYICNVNHKPSN TKVDKRVEPKSCDKTHTCPPCPAPELLGGPSVFLFPPKPKDTLMIS RTPEVTCVVVDVSHEDPEVKFNWYVDGVEVHNAKTKPREEQYAS TYRVVSVLTVLHQDWLNGKEYKCKVSNKALPAPIEKTISKAKGQPR EPQVYTLPPSRDELTKNQVSLSCAVKGFYPSDIAVEWESNGQPEN NYKTTPPVLDSDGSFFLVSKLTVDKSRWQQGNVFSCSVMHEALH NHYTQKSLSLSPGK | CH1-3 IgG1 (N297A/ Y349C/ T366S/ L368A/ Y407V) |
| 232 | EPKSSDKTHTCPPCPAPELLGGPSVFLFPPKPKDTLMISRTPEVTC VVVDVSHEDPEVKFNWYVDGVEVHNAKTKPREEQYNSTYRVVSV LTVLHQDWLNGKEYKCKVSNKALPAPIEKTISKAKGQPREPQVYTL PPSRDELTKNQVSLTCLVKGFYPSDIAVEWESNGQPENNYKTTPP VLDSDGSFFLYSKLTVDKSRWQQGNVFSCSVMHEALHNHYTQKS LSLSPGK | Fc IgG1 |
| 233 | EPKSSDKTHTCPPCPAPELLGGPSVFLFPPKPKDTLMISRTPEVTC VVVDVSHEDPEVKFNWYVDGVEVHNAKTKPREEQYASTYRVVSV LTVLHQDWLNGKEYKCKVSNKALPAPIEKTISKAKGQPREPQVYTL PPSRDELTKNQVSLTCLVKGFYPSDIAVEWESNGQPENNYKTTPP VLDSDGSFFLYSKLTVDKSRWQQGNVFSCSVMHEALHNHYTQKS LSLSPGK | Fc IgG1 (N297A) |
| 234 | EPKSSDKTHTCPPCPAPEFEGGPSVFLFPPKPKDTLMISRTPEVTC VVVDVSHEDPEVKFNWYVDGVEVHNAKTKPREEQYNSTYRVVSV LTVLHQDWLNGKEYKCKVSNKALPASIEKTISKAKGQPREPQVYTL PPSRDELTKNQVSLTCLVKGFYPSDIAVEWESNGQPENNYKTTPP VLDSDGSFFLYSKLTVDKSRWQQGNVFSCSVMHEALHNHYTQKS LSLSPGK | Fc IgG1 (L234F/L23 5E/P331S) |
| 235 | EPKSSDKTHTCPPCPAPELLGGPSVFLFPPKPKDTLMISRTPEVTC VVVDVSHEDPEVKFNWYVDGVEVHNAKTKPREEQYNSTYRVVSV LTVLHQDWLNGKEYKCKVSNKALPAPIEKTISKAKGQPREPQVCTL PPSRDELTKNQVSLTCLVEGFYPSDIAVEWESNGQPENNYKTTPP VLDSDGSFFLYSDLTVDKSRWQQGNVFSCSVMHEALHNHYTQES LSLSPGK | Fc IgG1 (Y349C/K37 0E/K409D/K 439E) |
| 236 | EPKSSDKTHTCPPCPAPELLGGPSVFLFPPKPKDTLMISRTPEVTC VVVDVSHEDPEVKFNWYVDGVEVHNAKTKPREEQYNSTYRVVSV LTVLHQDWLNGKEYKCKVSNKALPAPIEKTISKAKGQPREPQVYTL PPCRKKLTKNQVSLTCLVKGFYPSDIAVEWESNGQPENNYKTTPP VLKSDGSFFLYSKLTVDKSRWQQGNVFSCSVMHEALHNHYTQKS LSLSPGK | Fc IgG1 (S354C/ D356K/ E357K/ D399K) |
| 237 | EPKSSDKTHTCPPCPAPELLGGPSVFLFPPKPKDTLMISRTPEVTC VVVDVSHEDPEVKFNWYVDGVEVHNAKTKPREEQYNSTYRVVSV LTVLHQDWLNGKEYKCKVSNKALPAPIEKTISKAKGQPREPQVYTL PPSRDELTKNQVSLWCLVKGFYPSDIAVEWESNGQPENNYKTTPP VLDSDGSFFLYSKLTVDKSRWQQGNVFSCSVMHEALHNHYTQKS LSLSPGK | Fc IgG1 (S354C/T36 6W) |
| 238 | EPKSSDKTHTCPPCPAPELLGGPSVFLFPPKPKDTLMISRTPEVTC VVVDVSHEDPEVKFNWYVDGVEVHNAKTKPREEQYNSTYRVVSV LTVLHQDWLNGKEYKCKVSNKALPAPIEKTISKAKGQPREPQVYTL PPSRDELTKNQVSLSCAVKGFYPSDIAVEWESNGQPENNYKTTPP VLDSDGSFFLVSKLTVDKSRWQQGNVFSCSVMHEALHNHYTQKS LSLSPGK | Fc IgG1 (Y349C/ T366S/ L368A/ Y407V) |

TABLE 20-continued

SEQUENCES

| Seq ID | sequence | name |
|---|---|---|
| 239 | EPKSSDKTHTCPPCPAPEFEGGPSVFLFPPKPKDTLMISRTPEVTC VVVDVSHEDPEVKFNWYVDGVEVHNAKTKPREEQYNSTYRVVSV LTVLHQDWLNGKEYKCKVSNKALPASIEKTISKAKGQPREPQVCTL PPSRDELTKNQVSLTCLVEGFYPSDIAVEWESNGQPENNYKTTPP VLDSDGSFFLYSDLTVDKSRWQQGNVFSCSVMHEALHNHYTQES LSLSPGK | Fc IgG1 (L234F/L235E/P331S/ Y349C/K370E/K409D/K439E) |
| 240 | EPKSSDKTHTCPPCPAPEFEGGPSVFLFPPKPKDTLMISRTPEVTC VVVDVSHEDPEVKFNWYVDGVEVHNAKTKPREEQYNSTYRVVSV LTVLHQDWLNGKEYKCKVSNKALPASIEKTISKAKGQPREPQVYTL PPCRKKLTKNQVSLTCLVKGFYPSDIAVEWESNGQPENNYKTTPP VLKSDGSFFLYSKLTVDKSRWQQGNVFSCSVMHEALHNHYTQKS LSLSPGK | Fc IgG1 (L234F/L235E/P331S/ S354C/ D356K/ E357K/ D399K) |
| 241 | EPKSSDKTHTCPPCPAPEFEGGPSVFLFPPKPKDTLMISRTPEVTC VVVDVSHEDPEVKFNWYVDGVEVHNAKTKPREEQYNSTYRVVSV LTVLHQDWLNGKEYKCKVSNKALPASIEKTISKAKGQPREPQVYTL PPSRDELTKNQVSLWCLVKGFYPSDIAVEWESNGQPENNYKTTPP VLDSDGSFFLYSKLTVDKSRWQQGNVFSCSVMHEALHNHYTQKS LSLSPGK | Fc IgG1 (L234F/L235E/P331S/ S354C/T366W) |
| 242 | EPKSSDKTHTCPPCPAPEFEGGPSVFLFPPKPKDTLMISRTPEVTC VVVDVSHEDPEVKFNWYVDGVEVHNAKTKPREEQYNSTYRVVSV LTVLHQDWLNGKEYKCKVSNKALPASIEKTISKAKGQPREPQVYTL PPSRDELTKNQVSLSCAVKGFYPSDIAVEWESNGQPENNYKTTPP VLDSDGSFFLVSKLTVDKSRWQQGNVFSCSVMHEALHNHYTQKS LSLSPGK | Fc IgG1 (L234F/L235E/P331S/ Y349C/ T366S/ L368A/ Y407V) |
| 243 | EPKSSDKTHTCPPCPAPELLGGPSVFLFPPKPKDTLMISRTPEVTC VVVDVSHEDPEVKFNWYVDGVEVHNAKTKPREEQYASTYRVVSV LTVLHQDWLNGKEYKCKVSNKALPAPIEKTISKAKGQPREPQVCTL PPSRDELTKNQVSLTCLVEGFYPSDIAVEWESNGQPENNYKTTPP VLDSDGSFFLYSDLTVDKSRWQQGNVFSCSVMHEALHNHYTQES LSLSPGK | Fc IgG1 (N297A/ Y349C/K370E/K409D/K439E) |
| 244 | EPKSSDKTHTCPPCPAPELLGGPSVFLFPPKPKDTLMISRTPEVTC VVVDVSHEDPEVKFNWYVDGVEVHNAKTKPREEQYASTYRVVSV LTVLHQDWLNGKEYKCKVSNKALPAPIEKTISKAKGQPREPQVYTL PPCRKKLTKNQVSLTCLVKGFYPSDIAVEWESNGQPENNYKTTPP VLKSDGSFFLYSKLTVDKSRWQQGNVFSCSVMHEALHNHYTQKS LSLSPGK | Fc IgG1 (N297A/ S354C/ D356K/ E357K/ D399K) |
| 245 | EPKSSDKTHTCPPCPAPELLGGPSVFLFPPKPKDTLMISRTPEVTC VVVDVSHEDPEVKFNWYVDGVEVHNAKTKPREEQYASTYRVVSV LTVLHQDWLNGKEYKCKVSNKALPAPIEKTISKAKGQPREPQVYTL PPSRDELTKNQVSLWCLVKGFYPSDIAVEWESNGQPENNYKTTPP VLDSDGSFFLYSKLTVDKSRWQQGNVFSCSVMHEALHNHYTQKS LSLSPGK | Fc IgG1 (N297A/ S354C/T366W) |
| 246 | EPKSSDKTHTCPPCPAPELLGGPSVFLFPPKPKDTLMISRTPEVTC VVVDVSHEDPEVKFNWYVDGVEVHNAKTKPREEQYASTYRVVSV LTVLHQDWLNGKEYKCKVSNKALPAPIEKTISKAKGQPREPQVYTL PPSRDELTKNQVSLSCAVKGFYPSDIAVEWESNGQPENNYKTTPP VLDSDGSFFLVSKLTVDKSRWQQGNVFSCSVMHEALHNHYTQKS LSLSPGK | Fc IgG1 (N297A/ Y349C/ T366S/ L368A/ Y407V) |
| 247 | RTVAAPSVFIFPPSDEQLKSGTASVVCLLNNFYPREAKVQWKVDN ALQSGNSQESVTEQDSKDSTYSLSSTLTLSKADYEKHKVYACEVT HQGLSSPVTKSFNRGEC | CL1 |
| 248 | EVQLVESGGGLVQPKGSLKLSCAASGFTFNTYAMNWVRQAPGKG LEWVARIRSKYNNYATYYADSVKDRFTISRDDSQSILYLQMNNLKT EDTAMYYCVRHGNFGNSYVSWFAYWGQGTLVTVSS | VH; CD3vA |
| 249 | EVQLVESGGGLVQPGGSLRLSCAASGFTFSTYAMNWVRQAPGK GLEWVGRIRSKANNYATYYADSVKGRFTISRDDSKNTLYLQMNSL RAEDTAVYYCVRHGNFGDSYVSWFAYWGQGTLVTVSS | VH; CD3vB |
| 250 | EVQLVESGGGLVQPGGSLRLSCAASGFTFSTYAMNWVRQAPGK GLEWVGRIRSKYNNYATYYADSVKGRFTISRDDSKNTLYLQMNSL RAEDTAVYYCVRHGNFGDSYVSWFAYWGQGTLVTVSS | VH; CD3vC |

TABLE 20-continued

SEQUENCES

| Seq ID | sequence | name |
|---|---|---|
| 251 | EVQLVESGGGLVQPGGSLRLSCAASGFTFSTYAMNWVRQAPGK GLEWVGRIRSKINNYATYYADSVKGRFTISRDDSKNTLYLQMNSLR AEDTAVYYCVRHGNFGDSYVSWFAYWGQGTLVTVSS | VH; CD3vD |
| 252 | EVQLVESGGGLVQPGGSLRLSCAASGFTFSTYAMNWVRQAPGK GLEWVGRIRSKLNNYATYYADSVKGRFTISRDDSKNTLYLQMNSL RAEDTAVYYCVRHGNFGDSYVSWFAYWGQGTLVTVSS | VH; CD3vE |
| 253 | EVQLVESGGGLVQPGGSLRLSCAASGFTFSTYAMNWVRQAPGK GLEWVGRIRSKVNNYATYYADSVKGRFTISRDDSKNTLYLQMNSL RAEDTAVYYCVRHGNFGDSYVSWFAYWGQGTLVTVSS | VH; CD3vF |
| 254 | EVQLVESGGGLVQPGGSLRLSCAASGFTFSTYAMNWVRQAPGK GLEWVGRIRSKSNNYATYYADSVKGRFTISRDDSKNTLYLQMNSL RAEDTAVYYCVRHGNFGDSYVSWFAYWGQGTLVTVSS | VH; CD3vG |
| 255 | EVQLVESGGGLVQPGGSLRLSCAASGFTFSTYAMDWVRQAPGK GLEWVGRIRSKYNNYATYYADSVKGRFTISRDDSKNTLYLQMNSL RAEDTAVYYCVRHGNFGDSYVSWFAYWGQGTLVTVSS | VH; CD3vH |
| 256 | EVQLVESGGGLVQPGGSLRLSCAASGFTFSTYAMNWVRQAPGK GLEWVGRIRSKYNNYATYYADSVKGRFTISRDDSKNTLYLQMNSL RAEDTAVYYCVRHGNFGDSYVSWFEYWGQGTLVTVSS | VH; CD3vI |
| 257 | EVQLVESGGGLVQPGGSLRLSCAASGFTFSTYAMNWVRQAPGK GLEWVGRIRSKYNNYATYYADSVKGRFTISRDDSKNTLYLQMNSL RAEDTAVYYCVRHGNFGDSYVSWFDYWGQGTLVTVSS | VH; CD3vJ |
| 258 | EVQLVESGGGLVQPGGSLRLSCAASGFTFSTYAMNWVRQAPGK GLEWVGRIRSKYNNYATYYADSVKGRFTISRDDSKNTLYLQMNSL RAEDTAVYYCVRHGNFGDSYVSWFNYWGQGTLVTVSS | VH; CD3vK |
| 259 | EVQLVESGGGLVQPGGSLRLSCAASGFTFSTYAMNWVRQAPGK GLEWVGRIRSKYNNYATYYADSVKGRFTISRDDSKNTLYLQMNSL RAEDTAVYYCVRHGNFGDSYVSYFAYWGQGTLVTVSS | VH; CD3vL |
| 260 | QLVESGGGLVQPGGSLRLSCAASGFTFSTYAMNWVRQAPGKGLE WVGRIRSKANNYATYYADSVKGRFTISRDDSKNTLYLQMNSLRAE DTAVYYCVRHGNFGDSYVSWFAYWGQGTLVTVSS | VH; CD3vB2 |
| 261 | QAVVTQEPSLTVSPGGTVTLTCGSSTGAVTTSNYANWVQQKPGK SPRGLIGGTNKRAPGVPARFSGSLLGGKAALTISGAQPEDEADYY CALWYSNHWVFGGGTKLTVL | VL; CD3 |
| 262 | EVQLVESGGGLVQPGGSLRLSCAASGFTFSTYAMNWVRQAPGK GLEWVGRIRSKANNYATYYADSVKGRFTISRDDSKNTLYLQMNSL RAEDTAVYYCVRHGNFGDSYVSWFAYWGQGTLVTVSSGKPGSG KPGSGKPGSGKPGSQAVVTQEPSLTVSPGGTVTLTCGSSTGAVT TSNYANWVQQKPGKSPRGLIGGTNKRAPGVPARFSGSLLGGKAA LTISGAQPEDEADYYCALWYSNHWVFGGGTKLTVLEPKSSDKTHT CPPCPAPEFEGGPSVFLFPPKPKDTLMISRTPEVTCVVVDVSHED PEVKFNWYVDGVEVHNAKTKPREEQYNSTYRVVSVLTVLHQDWL NGKEYKCKVSNKALPASIEKTISKAKGQPREPQVYTLPPCRKKLTK NQVSLTCLVKGFYPSDIAVEWESNGQPENNYKTTPPVLKSDGSFF LYSKLTVDKSRWQQGNVFSCSVMHEALHNHYTQKSLSLSPGK | CD3vB scfv-Fc |
| 263 | EVQLVESGGGLVQPGGSLRLSCAASGFTFSTYAMNWVRQAPGK GLEWVGRIRSKYNNYATYYADSVKGRFTISRDDSKNTLYLQMNSL RAEDTAVYYCVRHGNFGDSYVSWFAYWGQGTLVTVSSGKPGSG KPGSGKPGSGKPGSQAVVTQEPSLTVSPGGTVTLTCGSSTGAVT TSNYANWVQQKPGKSPRGLIGGTNKRAPGVPARFSGSLLGGKAA LTISGAQPEDEADYYCALWYSNHWVFGGGTKLTVLEPKSSDKTHT CPPCPAPEFEGGPSVFLFPPKPKDTLMISRTPEVTCVVVDVSHED PEVKFNWYVDGVEVHNAKTKPREEQYNSTYRVVSVLTVLHQDWL NGKEYKCKVSNKALPASIEKTISKAKGQPREPQVYTLPPCRKKLTK NQVSLTCLVKGFYPSDIAVEWESNGQPENNYKTTPPVLKSDGSFF LYSKLTVDKSRWQQGNVFSCSVMHEALHNHYTQKSLSLSPGK | CD3vC scfv-Fc |
| 264 | EVQLVESGGGLVQPGGSLRLSCAASGFTFSTYAMNWVRQAPGK GLEWVGRIRSKINNYATYYADSVKGRFTISRDDSKNTLYLQMNSLR AEDTAVYYCVRHGNFGDSYVSWFAYWGQGTLVTVSSGKPGSGK PGSGKPGSGKPGSQAVVTQEPSLTVSPGGTVTLTCGSSTGAVTT SNYANWVQQKPGKSPRGLIGGTNKRAPGVPARFSGSLLGGKAAL TISGAQPEDEADYYCALWYSNHWVFGGGTKLTVLEPKSSDKTHTC PPCPAPEFEGGPSVFLFPPKPKDTLMISRTPEVTCVVVDVSHEDPE | CD3vD scfv-Fc |

TABLE 20-continued

SEQUENCES

| Seq ID | sequence | name |
|---|---|---|
|  | VKFNWYVDGVEVHNAKTKPREEQYNSTYRVVSVLTVLHQDWLNG<br>KEYKCKVSNKALPASIEKTISKAKGQPREPQVYTLPPCRKKLTKNQ<br>VSLTCLVKGFYPSDIAVEWESNGQPENNYKTTPPVLKSDGSFFLY<br>SKLTVDKSRWQQGNVFSCSVMHEALHNHYTQKSLSLSPGK |  |
| 265 | EVQLVESGGGLVQPGGSLRLSCAASGFTFSTYAMNWVRQAPGK<br>GLEWVGRIRSKLNNYATYYADSVKGRFTISRDDSKNTLYLQMNSL<br>RAEDTAVYYCVRHGNFGDSYVSWFAYWGQGTLVTVSSGKPGSG<br>KPGSGKPGSGKPGSQAVVTQEPSLTVSPGGTVTLTCGSSTGAVT<br>TSNYANWVQQKPGKSPRGLIGGTNKRAPGVPARFSGSLLGGKAA<br>LTISGAQPEDEADYYCALWYSNHWVFGGGTKLTVLEPKSSDKTHT<br>CPPCPAPEFEGGPSVFLFPPKPKDTLMISRTPEVTCVVVDVSHED<br>PEVKFNWYVDGVEVHNAKTKPREEQYNSTYRVVSVLTVLHQDWL<br>NGKEYKCKVSNKALPASIEKTISKAKGQPREPQVYTLPPCRKKLTK<br>NQVSLTCLVKGFYPSDIAVEWESNGQPENNYKTTPPVLKSDGSFF<br>LYSKLTVDKSRWQQGNVFSCSVMHEALHNHYTQKSLSLSPGK | CD3vE<br>scfv-Fc |
| 266 | EVQLVESGGGLVQPGGSLRLSCAASGFTFSTYAMNWVRQAPGK<br>GLEWVGRIRSKVNNYATYYADSVKGRFTISRDDSKNTLYLQMNSL<br>RAEDTAVYYCVRHGNFGDSYVSWFAYWGQGTLVTVSSGKPGSG<br>KPGSGKPGSGKPGSQAVVTQEPSLTVSPGGTVTLTCGSSTGAVT<br>TSNYANWVQQKPGKSPRGLIGGTNKRAPGVPARFSGSLLGGKAA<br>LTISGAQPEDEADYYCALWYSNHWVFGGGTKLTVLEPKSSDKTHT<br>CPPCPAPEFEGGPSVFLFPPKPKDTLMISRTPEVTCVVVDVSHED<br>PEVKFNWYVDGVEVHNAKTKPREEQYNSTYRVVSVLTVLHQDWL<br>NGKEYKCKVSNKALPASIEKTISKAKGQPREPQVYTLPPCRKKLTK<br>NQVSLTCLVKGFYPSDIAVEWESNGQPENNYKTTPPVLKSDGSFF<br>LYSKLTVDKSRWQQGNVFSCSVMHEALHNHYTQKSLSLSPGK | CD3vF scfv-fc |
| 267 | EVQLVESGGGLVQPGGSLRLSCAASGFTFSTYAMNWVRQAPGK<br>GLEWVGRIRSKSNNYATYYADSVKGRFTISRDDSKNTLYLQMNSL<br>RAEDTAVYYCVRHGNFGDSYVSWFAYWGQGTLVTVSSGKPGSG<br>KPGSGKPGSGKPGSQAVVTQEPSLTVSPGGTVTLTCGSSTGAVT<br>TSNYANWVQQKPGKSPRGLIGGTNKRAPGVPARFSGSLLGGKAA<br>LTISGAQPEDEADYYCALWYSNHWVFGGGTKLTVLEPKSSDKTHT<br>CPPCPAPEFEGGPSVFLFPPKPKDTLMISRTPEVTCVVVDVSHED<br>PEVKFNWYVDGVEVHNAKTKPREEQYNSTYRVVSVLTVLHQDWL<br>NGKEYKCKVSNKALPASIEKTISKAKGQPREPQVYTLPPCRKKLTK<br>NQVSLTCLVKGFYPSDIAVEWESNGQPENNYKTTPPVLKSDGSFF<br>LYSKLTVDKSRWQQGNVFSCSVMHEALHNHYTQKSLSLSPGK | CD3vG<br>scfv-Fc |
| 268 | EVQLVESGGGLVQPGGSLRLSCAASGFTFSTYAMDWVRQAPGK<br>GLEWVGRIRSKYNNYATYYADSVKGRFTISRDDSKNTLYLQMNSL<br>RAEDTAVYYCVRHGNFGDSYVSWFAYWGQGTLVTVSSGKPGSG<br>KPGSGKPGSGKPGSQAVVTQEPSLTVSPGGTVTLTCGSSTGAVT<br>TSNYANWVQQKPGKSPRGLIGGTNKRAPGVPARFSGSLLGGKAA<br>LTISGAQPEDEADYYCALWYSNHWVFGGGTKLTVLEPKSSDKTHT<br>CPPCPAPEFEGGPSVFLFPPKPKDTLMISRTPEVTCVVVDVSHED<br>PEVKFNWYVDGVEVHNAKTKPREEQYNSTYRVVSVLTVLHQDWL<br>NGKEYKCKVSNKALPASIEKTISKAKGQPREPQVYTLPPCRKKLTK<br>NQVSLTCLVKGFYPSDIAVEWESNGQPENNYKTTPPVLKSDGSFF<br>LYSKLTVDKSRWQQGNVFSCSVMHEALHNHYTQKSLSLSPGK | CD3vH<br>scfv-Fc |
| 269 | EVQLVESGGGLVQPGGSLRLSCAASGFTFSTYAMNWVRQAPGK<br>GLEWVGRIRSKYNNYATYYADSVKGRFTISRDDSKNTLYLQMNSL<br>RAEDTAVYYCVRHGNFGDSYVSWFEYWGQGTLVTVSSGKPGSG<br>KPGSGKPGSGKPGSQAVVTQEPSLTVSPGGTVTLTCGSSTGAVT<br>TSNYANWVQQKPGKSPRGLIGGTNKRAPGVPARFSGSLLGGKAA<br>LTISGAQPEDEADYYCALWYSNHWVFGGGTKLTVLEPKSSDKTHT<br>CPPCPAPEFEGGPSVFLFPPKPKDTLMISRTPEVTCVVVDVSHED<br>PEVKFNWYVDGVEVHNAKTKPREEQYNSTYRVVSVLTVLHQDWL<br>NGKEYKCKVSNKALPASIEKTISKAKGQPREPQVYTLPPCRKKLTK<br>NQVSLTCLVKGFYPSDIAVEWESNGQPENNYKTTPPVLKSDGSFF<br>LYSKLTVDKSRWQQGNVFSCSVMHEALHNHYTQKSLSLSPGK | CD3vI scfv-Fc |
| 270 | EVQLVESGGGLVQPGGSLRLSCAASGFTFSTYAMNWVRQAPGK<br>GLEWVGRIRSKYNNYATYYADSVKGRFTISRDDSKNTLYLQMNSL<br>RAEDTAVYYCVRHGNFGDSYVSWFDYWGQGTLVTVSSGKPGSG<br>KPGSGKPGSGKPGSQAVVTQEPSLTVSPGGTVTLTCGSSTGAVT<br>TSNYANWVQQKPGKSPRGLIGGTNKRAPGVPARFSGSLLGGKAA<br>LTISGAQPEDEADYYCALWYSNHWVFGGGTKLTVLEPKSSDKTHT<br>CPPCPAPEFEGGPSVFLFPPKPKDTLMISRTPEVTCVVVDVSHED<br>PEVKFNWYVDGVEVHNAKTKPREEQYNSTYRVVSVLTVLHQDWL<br>NGKEYKCKVSNKALPASIEKTISKAKGQPREPQVYTLPPCRKKLTK<br>NQVSLTCLVKGFYPSDIAVEWESNGQPENNYKTTPPVLKSDGSFF<br>LYSKLTVDKSRWQQGNVFSCSVMHEALHNHYTQKSLSLSPGK | CD3vJ scfv-Fc |

TABLE 20-continued

SEQUENCES

| Seq ID | sequence | name |
|---|---|---|
| 271 | EVQLVESGGGLVQPGGSLRLSCAASGFTFSTYAMNWVRQAPGK GLEWVGRIRSKYNNYATYYADSVKGRFTISRDDSKNTLYLQMNSL RAEDTAVYYCVRHGNFGDSYVSWFNYWGQGTLVTVSSGKPGSG KPGSGKPGSGKPGSQAVVTQEPSLTVSPGGTVTLTCGSSTGAVTT SNYANWVQQKPGKSPRGLIGGTNKRAPGVPARFSGSLLGGKAA LTISGAQPEDEADYYCALWYSNHWVFGGGTKLTVLEPKSSDKTHT CPPCPAPEFEGGPSVFLFPPKPKDTLMISRTPEVTCVVVDVSHED PEVKFNWYVDGVEVHNAKTKPREEQYNSTYRVVSVLTVLHQDWL NGKEYKCKVSNKALPASIEKTISKAKGQPREPQVYTLPPCRKKLTK NQVSLTCLVKGFYPSDIAVEWESNGQPENNYKTTPPVLKSDGSFF LYSKLTVDKSRWQQGNVFSCSVMHEALHNHYTQKSLSLSPGK | CD3vK scfv-Fc |
| 272 | EVQLVESGGGLVQPGGSLRLSCAASGFTFSTYAMNWVRQAPGK GLEWVGRIRSKYNNYATYYADSVKGRFTISRDDSKNTLYLQMNSL RAEDTAVYYCVRHGNFGDSYVSYFAYWGQGTLVTVSSGKPGSGK PGSGKPGSGKPGSQAVVTQEPSLTVSPGGTVTLTCGSSTGAVTT SNYANWVQQKPGKSPRGLIGGTNKRAPGVPARFSGSLLGGKAAL TISGAQPEDEADYYCALWYSNHWVFGGGTKLTVLEPKSSDKTHTC PPCPAPEFEGGPSVFLFPPKPKDTLMISRTPEVTCVVVDVSHEDPE VKFNWYVDGVEVHNAKTKPREEQYNSTYRVVSVLTVLHQDWLNG KEYKCKVSNKALPASIEKTISKAKGQPREPQVYTLPPCRKKLTKNQ VSLTCLVKGFYPSDIAVEWESNGQPENNYKTTPPVLKSDGSFFLY SKLTVDKSRWQQGNVFSCSVMHEALHNHYTQKSLSLSPGK | CD3vI scfv-Fc |
| 273 | QLVESGGGLVQPGGSLRLSCAASGFTFSTYAMNWVRQAPGKGLE WVGRIRSKANNYATYYADSVKGRFTISRDDSKNTLYLQMNSLRAE DTAVYYCVRHGNFGDSYVSWFAYWGQGTLVTVSSGKPGSGKPG SGKPGSGKPGSQAVVTQEPSLTVSPGGTVTLTCGSSTGAVTTSN YANWVQQKPGKSPRGLIGGTNKRAPGVPARFSGSLLGGKAALTIS GAQPEDEADYYCALWYSNHWVFGGGTKLTVLEPKSSDKTHTCPP CPAPEFEGGPSVFLFPPKPKDTLMISRTPEVTCVVVDVSHEDPEVK FNWYVDGVEVHNAKTKPREEQYNSTYRVVSVLTVLHQDWLNGKE YKCKVSNKALPASIEKTISKAKGQPREPQVYTLPPCRKKLTKNQVS LTCLVKGFYPSDIAVEWESNGQPENNYKTTPPVLKSDGSFFLYSKL TVDKSRWQQGNVFSCSVMHEALHNHYTQKSLSLSPGK | CD3vB2 |
| 274 | EVQLLESGGGLVQPGGSLRLSCAASGFTFSSYGMHWVRQAPGK GLEWVAVISGSGSSKYYADSVKGRFTISRDNSKNTLYLQMNSLRA EDTAVYYCARDWFFYLFDYWGQGTLVTVSSASTKGPSVFPLAPSS KSTSGGTAALGCLVKDYFPEPVTVSWNSGALTSGVHTFPAVLQSS GLYSLSSVVTVPSSSLGTQTYICNVNHKPSNTKVDKRVEPKSCDKT HTCPPCPAPEFEGGPSVFLFPPKPKDTLMISRTPEVTCVVVDVSHE DPEVKFNWYVDGVEVHNAKTKPREEQYNSTYRVVSVLTVLHQDW LNGKEYKCKVSNKALPASIEKTISKAKGQPREPQVCTLPPSRDELT KNQVSLTCLVEGFYPSDIAVEWESNGQPENNYKTTPPVLDSDGSF FLYSDLTVDKSRWQQGNVFSCSVMHEALHNHYTQESLSLSPGK | HC; DLL3 |
| 275 | EVQLLESGGGLVQPGGSLRLSCAASGFTFSSYGMHWVRQAPGK GLEWVAVISGSGSSKYYADSVKGRFTISRDNSKNTLYLQMNSLRA EDTAVYYCARDWFYIFDYWGQGTLVTVSSASTKGPSVFPLAPSS KSTSGGTAALGCLVKDYFPEPVTVSWNSGALTSGVHTFPAVLQSS GLYSLSSVVTVPSSSLGTQTYICNVNHKPSNTKVDKRVEPKSCDKT HTCPPCPAPEFEGGPSVFLFPPKPKDTLMISRTPEVTCVVVDVSHE DPEVKFNWYVDGVEVHNAKTKPREEQYNSTYRVVSVLTVLHQDW LNGKEYKCKVSNKALPASIEKTISKAKGQPREPQVCTLPPSRDELT KNQVSLTCLVEGFYPSDIAVEWESNGQPENNYKTTPPVLDSDGSF FLYSDLTVDKSRWQQGNVFSCSVMHEALHNHYTQESLSLSPGK | HC; DLL3.11, DLL3.15 |
| 276 | EVQLLESGGGLVQPGGSLRLSCAASGFTFSSYGMHWVRQAPGK GLEWVAVISHHGSSKYYADSVKGRFTISRDNSKNTLYLQMNSLRA EDTAVYYCARDWFFYLFDYWGQGTLVTVSSASTKGPSVFPLAPSS KSTSGGTAALGCLVKDYFPEPVTVSWNSGALTSGVHTFPAVLQSS GLYSLSSVVTVPSSSLGTQTYICNVNHKPSNTKVDKRVEPKSCDKT HTCPPCPAPEFEGGPSVFLFPPKPKDTLMISRTPEVTCVVVDVSHE DPEVKFNWYVDGVEVHNAKTKPREEQYNSTYRVVSVLTVLHQDW LNGKEYKCKVSNKALPASIEKTISKAKGQPREPQVCTLPPSRDELT KNQVSLTCLVEGFYPSDIAVEWESNGQPENNYKTTPPVLDSDGSF FLYSDLTVDKSRWQQGNVFSCSVMHEALHNHYTQESLSLSPGK | HC: DLL3.18, DLL3.22 |
| 277 | EVQLLESGGGLVQPGGSLRLSCAASGFTFSSYGMHWVRQAPGK GLEWVAVISHHGSSKYYADSVKGRFTISRDNSKNTLYLQMNSLRA EDTAVYYCARDWFYIFDYWGQGTLVTVSSASTKGPSVFPLAPSS KSTSGGTAALGCLVKDYFPEPVTVSWNSGALTSGVHTFPAVLQSS GLYSLSSVVTVPSSSLGTQTYICNVNHKPSNTKVDKRVEPKSCDKT HTCPPCPAPEFEGGPSVFLFPPKPKDTLMISRTPEVTCVVVDVSHE | HC; DLL3.5, DLL3.12, DLL3.26 |

TABLE 20-continued

SEQUENCES

| Seq ID | sequence | name |
|---|---|---|
| | DPEVKFNWYVDGVEVHNAKTKPREEQYNSTYRVVSVLTVLHQDW<br>LNGKEYKCKVSNKALPASIEKTISKAKGQPREPQVCTLPPSRDELT<br>KNQVSLTCLVEGFYPSDIAVEWESNGQPENNYKTTPPVLDSDGSF<br>FLYSDLTVDKSRWQQGNVFSCSVMHEALHNHYTQESLSLSPGK | |
| 278 | EVQLLESGGGLVQPGGSLRLSCAASGFTFSSYGMHWVRQAPGK<br>GLEWVAVISYDGSSKYYADSVKGRFTISRDNSKNTLYLQMNSLRA<br>EDTAVYYCARDWFFYLFDYWGQGTLVTVSSASTKGPSVFPLAPSS<br>KSTSGGTAALGCLVKDYFPEPVTVSWNSGALTSGVHTFPAVLQSS<br>GLYSLSSVVTVPSSSLGTQTYICNVNHKPSNTKVDKRVEPKSCDKT<br>HTCPPCPAPEFEGGPSVFLFPPKPKDTLMISRTPEVTCVVVDVSHE<br>DPEVKFNWYVDGVEVHNAKTKPREEQYNSTYRVVSVLTVLHQDW<br>LNGKEYKCKVSNKALPASIEKTISKAKGQPREPQVCTLPPSRDELT<br>KNQVSLTCLVEGFYPSDIAVEWESNGQPENNYKTTPPVLDSDGSF<br>FLYSDLTVDKSRWQQGNVFSCSVMHEALHNHYTQESLSLSPGK | HC;<br>DLL3.19,<br>DLL3.23 |
| 279 | EVQLLESGGGLVQPGGSLRLSCAASGFTFSSYGMHWVRQAPGK<br>GLEWVAVISYDGSSKYYADSVKGRFTISRDNSKNTLYLQMNSLRA<br>EDTAVYYCARDWFYFIFDYWGQGTLVTVSSASTKGPSVFPLAPSS<br>KSTSGGTAALGCLVKDYFPEPVTVSWNSGALTSGVHTFPAVLQSS<br>GLYSLSSVVTVPSSSLGTQTYICNVNHKPSNTKVDKRVEPKSCDKT<br>HTCPPCPAPEFEGGPSVFLFPPKPKDTLMISRTPEVTCVVVDVSHE<br>DPEVKFNWYVDGVEVHNAKTKPREEQYNSTYRVVSVLTVLHQDW<br>LNGKEYKCKVSNKALPASIEKTISKAKGQPREPQVCTLPPSRDELT<br>KNQVSLTCLVEGFYPSDIAVEWESNGQPENNYKTTPPVLDSDGSF<br>FLYSDLTVDKSRWQQGNVFSCSVMHEALHNHYTQESLSLSPGK | HC;<br>DLL3.13,<br>DLL3.16, |
| 280 | EVQLLESGGGLVQPGGSLRLSCAASGFTFSSYGMHWVRQAPGK<br>GLEWVSVISHHGSSKYYADSVKGRFTISRDNSKNTLYLQMNSLRA<br>EDTAVYYCAKDWFFYLFDYWGQGTLVTVSSASTKGPSVFPLAPSS<br>KSTSGGTAALGCLVKDYFPEPVTVSWNSGALTSGVHTFPAVLQSS<br>GLYSLSSVVTVPSSSLGTQTYICNVNHKPSNTKVDKRVEPKSCDKT<br>HTCPPCPAPEFEGGPSVFLFPPKPKDTLMISRTPEVTCVVVDVSHE<br>DPEVKFNWYVDGVEVHNAKTKPREEQYNSTYRVVSVLTVLHQDW<br>LNGKEYKCKVSNKALPASIEKTISKAKGQPREPQVCTLPPSRDELT<br>KNQVSLTCLVEGFYPSDIAVEWESNGQPENNYKTTPPVLDSDGSF<br>FLYSDLTVDKSRWQQGNVFSCSVMHEALHNHYTQESLSLSPGK | HC;<br>DLL3.20,<br>DLL3.24 |
| 281 | EVQLLESGGGLVQPGGSLRLSCAASGFTFSSYGMHWVRQAPGK<br>GLEWVSVISHHGSSKYYADSVKGRFTISRDNSKNTLYLQMNSLRA<br>EDTAVYYCAKDWFYFIFDYWGQGTLVTVSSASTKGPSVFPLAPSS<br>KSTSGGTAALGCLVKDYFPEPVTVSWNSGALTSGVHTFPAVLQSS<br>GLYSLSSVVTVPSSSLGTQTYICNVNHKPSNTKVDKRVEPKSCDKT<br>HTCPPCPAPEFEGGPSVFLFPPKPKDTLMISRTPEVTCVVVDVSHE<br>DPEVKFNWYVDGVEVHNAKTKPREEQYNSTYRVVSVLTVLHQDW<br>LNGKEYKCKVSNKALPASIEKTISKAKGQPREPQVCTLPPSRDELT<br>KNQVSLTCLVEGFYPSDIAVEWESNGQPENNYKTTPPVLDSDGSF<br>FLYSDLTVDKSRWQQGNVFSCSVMHEALHNHYTQESLSLSPGK | HC;<br>DLL3.14,<br>DLL3.17 |
| 282 | EVQLQQSGPVLVKPGASVKMSCKASGFTFTDYYMNWVKQSHGK<br>SLEWIGVINPDNGITTYNQKFKGKATLTVDKSSSTAYMELNGLTSE<br>DSAVYYCARGVWNYERSFDYWGQGTTLTVSSASTKGPSVFPLAP<br>SSKSTSGGTAALGCLVKDYFPEPVTVSWNSGALTSGVHTFPAVLQ<br>SSGLYSLSSVVTVPSSSLGTQTYICNVNHKPSNTKVDKRVEPKSC<br>DKTHTCPPCPAPEFEGGPSVFLFPPKPKDTLMISRTPEVTCVVVDV<br>SHEDPEVKFNWYVDGVEVHNAKTKPREEQYNSTYRVVSVLTVLH<br>QDWLNGKEYKCKVSNKALPASIEKTISKAKGQPREPQVCTLPPSR<br>DELTKNQVSLTCLVEGFYPSDIAVEWESNGQPENNYKTTPPVLDS<br>DGSFFLYSDLTVDKSRWQQGNVFSCSVMHEALHNHYTQESLSLS<br>PGK | HC;<br>DLL3.21,<br>DLL3.25 |
| 283 | EVQLVESGGGLVQPGGSLRLSCAASGFTFSNYGMHWVRQAPGK<br>GLEWVAVISHHGSSKYYADSVKGRYTISRDNSKNTLYLQMNSLRA<br>EDTAVYYCARDWFFYLFDYWGQGTLVTVSSASTKGPSVFPLAPSS<br>KSTSGGTAALGCLVKDYFPEPVTVSWNSGALTSGVHTFPAVLQSS<br>GLYSLSSVVTVPSSSLGTQTYICNVNHKPSNTKVDKRVEPKSCDKT<br>HTCPPCPAPEFEGGPSVFLFPPKPKDTLMISRTPEVTCVVVDVSHE<br>DPEVKFNWYVDGVEVHNAKTKPREEQYNSTYRVVSVLTVLHQDW<br>LNGKEYKCKVSNKALPASIEKTISKAKGQPREPQVCTLPPSRDELT<br>KNQVSLTCLVEGFYPSDIAVEWESNGQPENNYKTTPPVLDSDGSF<br>FLYSDLTVDKSRWQQGNVFSCSVMHEALHNHYTQESLSLSPGK | HC; DLL3.9 |
| 284 | QVQLQESGPGLVKPSETLSLTCTVSGGSISSYYWSWIRQPPGKGL<br>EWIGYVYYSGTTNYNPSLKSRVTISVDTSKNQFSLKLSSVTAADTA<br>VYYCASIAVTGFYDYWGQGTLVTVSSASTKGPSVFPLAPSSKST<br>SGGTAALGCLVKDYFPEPVTVSWNSGALTSGVHTFPAVLQSSGLY | HC;<br>DLL3.27 |

TABLE 20-continued

SEQUENCES

| Seq ID | sequence | name |
|---|---|---|
| | SLSSVVTVPSSSLGTQTYICNVNHKPSNTKVDKRVEPKSCDKTHT<br>CPPCPAPEFEGGPSVFLFPPKPKDTLMISRTPEVTCVVVDVSHED<br>PEVKFNWYVDGVEVHNAKTKPREEQYNSTYRVVSVLTVLHQDWL<br>NGKEYKCKVSNKALPASIEKTISKAKGQPREPQVCTLPPSRDELTK<br>NQVSLTCLVEGFYPSDIAVEWESNGQPENNYKTTPPVLDSDGSFF<br>LYSDLTVDKSRWQQGNVFSCSVMHEALHNHYTQESLSLSPGK | |
| 285 | QVQLQQSGPVLVKPGASVKMSCKASGYSFTDYYVNWVKQSHGK<br>SLEWIGIISPNDGGTNYNQKFKGKATLTVDKSSSTAYMEVNSLTSE<br>DSAVYYCARDDDLGWYFDVWGTGTTVTVSSASTKGPSVFPLAPS<br>SKSTSGGTAALGCLVKDYFPEPVTVSWNSGALTSGVHTFPAVLQS<br>SGLYSLSSVVTVPSSSLGTQTYICNVNHKPSNTKVDKRVEPKSCD<br>KTHTCPPCPAPEFEGGPSVFLFPPKPKDTLMISRTPEVTCVVVDVS<br>HEDPEVKFNWYVDGVEVHNAKTKPREEQYNSTYRVVSVLTVLHQ<br>DWLNGKEYKCKVSNKALPASIEKTISKAKGQPREPQVCTLPPSRD<br>ELTKNQVSLTCLVEGFYPSDIAVEWESNGQPENNYKTTPPVLDSD<br>GSFFLYSDLTVDKSRWQQGNVFSCSVMHEALHNHYTQESLSLSP<br>GK | HC;<br>DLL3.28 |
| 286 | QVQLVESGGGAVQPGRSLRLSCAASGFTFSNYGMHWVRQAPGK<br>GLEWVAVISHHGSSKYYARSVKGRFTISRDNSKNTLYLEMNSLRA<br>EDTAVYYCARDWWELVFDYWGQGTLVTVSSASTKGPSVFPLAPS<br>SKSTSGGTAALGCLVKDYFPEPVTVSWNSGALTSGVHTFPAVLQS<br>SGLYSLSSVVTVPSSSLGTQTYICNVNHKPSNTKVDKRVEPKSCD<br>KTHTCPPCPAPEFEGGPSVFLFPPKPKDTLMISRTPEVTCVVVDVS<br>HEDPEVKFNWYVDGVEVHNAKTKPREEQYNSTYRVVSVLTVLHQ<br>DWLNGKEYKCKVSNKALPASIEKTISKAKGQPREPQVCTLPPSRD<br>ELTKNQVSLTCLVEGFYPSDIAVEWESNGQPENNYKTTPPVLDSD<br>GSFFLYSDLTVDKSRWQQGNVFSCSVMHEALHNHYTQESLSLSP<br>GK | HC;<br>DLL3.8 |
| 287 | QVQLVESGGGAVQPGRSLRLSCAASGFTFSNYGMHWVRQAPGK<br>GLEWVAVISHHGSSKYYARSVKGRFTISRDNSKNTLYLEMNSLRA<br>EDTAVYYCARDWWELVFDYWGQGTLVTVSSASTKGPSVFPLAPS<br>SKSTSGGTAALGCLVKDYFPEPVTVSWNSGALTSGVHTFPAVLQS<br>SGLYSLSSVVTVPSSSLGTQTYICNVNHKPSNTKVDKRVEPKSCD<br>KTHTCPPCPAPEFEGGPSVFLFPPKPKDTLMISRTPEVTCVVVDVS<br>HEDPEVKFNWYVDGVEVHNAKTKPREEQYNSTYRVVSVLTVLHQ<br>DWLNGKEYKCKVSNKALPASIEKTISKAKGQPREPQVCTLPPSRD<br>ELTKNQVSLTCLVEGFYPSDIAVEWESNGQPENNYKTTPPVLDSD<br>GSFFLYSDLTVDKSRWQQGNVFSCSVMHEALHNHYTQESLSLSP<br>GK | HC;<br>DLL3.29,<br>DLL3.30,<br>DLL3.36 |
| 288 | QVQLVESGGGVVQPGRSLRLSCAASGFTFSNYGMHWVRQAPGK<br>GLEWVAVISHHGSSKYYADSVKGRFTISRDNSKNTLYLQMNSLRA<br>EDTAVYYCARDWFFYLFDYWGQGTLVTVSSASTKGPSVFPLAPSS<br>KSTSGGTAALGCLVKDYFPEPVTVSWNSGALTSGVHTFPAVLQSS<br>GLYSLSSVVTVPSSSLGTQTYICNVNHKPSNTKVDKRVEPKSCDKT<br>HTCPPCPAPEFEGGPSVFLFPPKPKDTLMISRTPEVTCVVVDVSHE<br>DPEVKFNWYVDGVEVHNAKTKPREEQYNSTYRVVSVLTVLHQDW<br>LNGKEYKCKVSNKALPASIEKTISKAKGQPREPQVCTLPPSRDELT<br>KNQVSLTCLVEGFYPSDIAVEWESNGQPENNYKTTPPVLDSDGSF<br>FLYSDLTVDKSRWQQGNVFSCSVMHEALHNHYTQESLSLSPGK | HC<br>DLL3.10,<br>DLL3.31 |
| 289 | QVQLVESGGGVVQPGRSLRLSCAASGFTFSNYGMHWVRQAPGK<br>GLEWVAVISHHGSSKYYADSVKGRFTISRDNSKNTLYLQMNSLRA<br>EDTAVYYCARDWFYFIFDYWGQGTLVTVSSASTKGPSVFPLAPSS<br>KSTSGGTAALGCLVKDYFPEPVTVSWNSGALTSGVHTFPAVLQSS<br>GLYSLSSVVTVPSSSLGTQTYICNVNHKPSNTKVDKRVEPKSCDKT<br>HTCPPCPAPEFEGGPSVFLFPPKPKDTLMISRTPEVTCVVVDVSHE<br>DPEVKFNWYVDGVEVHNAKTKPREEQYNSTYRVVSVLTVLHQDW<br>LNGKEYKCKVSNKALPASIEKTISKAKGQPREPQVCTLPPSRDELT<br>KNQVSLTCLVEGFYPSDIAVEWESNGQPENNYKTTPPVLDSDGSF<br>FLYSDLTVDKSRWQQGNVFSCSVMHEALHNHYTQESLSLSPGK | HC;<br>DLL3.32,<br>DLL3.33 |
| 290 | QVQLVQSGAEVKKPGASVKVSCKASDYTFSNYYIEWVRQAPGQG<br>LEWMGEILPGNGNTVYNEKFKDRVTMTVDTSTSTAYMELRSLRSD<br>DTAVYYCARWGDYALFANWGQGTLVTVSSASTKGPSVFPLAPSS<br>KSTSGGTAALGCLVKDYFPEPVTVSWNSGALTSGVHTFPAVLQSS<br>GLYSLSSVVTVPSSSLGTQTYICNVNHKPSNTKVDKRVEPKSCDKT<br>HTCPPCPAPEFEGGPSVFLFPPKPKDTLMISRTPEVTCVVVDVSHE<br>DPEVKFNWYVDGVEVHNAKTKPREEQYNSTYRVVSVLTVLHQDW<br>LNGKEYKCKVSNKALPASIEKTISKAKGQPREPQVCTLPPSRDELK<br>NQVSLTCLVEGFYPSDIAVEWESNGQPENNYKTTPPVLDSDGSFF<br>LYSDLTVDKSRWQQGNVFSCSVMHEALHNHYTQESLSLSPGK | HC; DLL3.1 |

TABLE 20-continued

SEQUENCES

| Seq ID | sequence | name |
|---|---|---|
| 291 | QVQLVQSGAEVKKPGASVKVSCKASGYTFTDYFMNWVRQAPGQ GLEWMGVINPYNDITIYNQKFQGRVTMTVDRSTSTVYMELSSLRS EDTAVYYCAREGVLYDGYYEGAYWGQGTLVTVSSASTKGPSVFP LAPSSKSTSGGTAALGCLVKDYFPEPVTVSWNSGALTSGVHTFPA VLQSSGLYSLSSVVTVPSSSLGTQTYICNVNHKPSNTKVDKRVEPK SCDKTHTCPPCPAPEFEGGPSVFLFPPKPKDTLMISRTPEVTCVVV DVSHEDPEVKFNWYVDGVEVHNAKTKPREEQYNSTYRVVSVLTV LHQDWLNGKEYKCKVSNKALPASIEKTISKAKGQPREPQVCTLPP SRDELTKNQVSLTCLVEGFYPSDIAVEWESNGQPENNYKTTPPVL DSDGSFFLYSDLTVDKSRWQQGNVFSCSVMHEALHNHYTQESLS LSPGK | HC; DLL3.3 |
| 292 | QVQLVQSGAEVKKPGASVKVSCKATDYIFSNYYIEWVRQAPGQGL EWMGEILPGTGNTVYNEKFKDRVTMTVDTSTSTVYMELSSLRSED TAVYYCARWGDYALFANWGQGTLVTVSSASTKGPSVFPLAPSSK STSGGTAALGCLVKDYFPEPVTVSWNSGALTSGVHTFPAVLQSSG LYSLSSVVTVPSSSLGTQTYICNVNHKPSNTKVDKRVEPKSCDKTH TCPPCPAPEFEGGPSVFLFPPKPKDTLMISRTPEVTCVVVDVSHED PEVKFNWYVDGVEVHNAKTKPREEQYNSTYRVVSVLTVLHQDWL NGKEYKCKVSNKALPASIEKTISKAKGQPREPQVCTLPPSRDELTK NQVSLTCLVEGFYPSDIAVEWESNGQPENNYKTTPPVLDSDGSFF LYSDLTVDKSRWQQGNVFSCSVMHEALHNHYTQESLSLSPGK | HC; DLL3.2, DLL3.4 |
| 293 | SDVQLQESGPGLVKPSQSLSLTCSVTGYSITSAYYWNWIRQFPGN KLEWMGYISDVGHNYYNPSLKNRISITRDTSKNQFFLKLNSVTPED TATYYCARDQVFAYWGQGTLVTVSAASTKGPSVFPLAPSSKSTSG GTAALGCLVKDYFPEPVTVSWNSGALTSGVHTFPAVLQSSGLYSL SSVVTVPSSSLGTQTYICNVNHKPSNTKVDKRVEPKSCDKTHTCP PCPAPEFEGGPSVFLFPPKPKDTLMISRTPEVTCVVVDVSHEDPEV KFNWYVDGVEVHNAKTKPREEQYNSTYRVVSVLTVLHQDWLNGK EYKCKVSNKALPASIEKTISKAKGQPREPQVCTLPPSRDELTKNQV SLTCLVEGFYPSDIAVEWESNGQPENNYKTTPPVLDSDGSFFLYS DLTVDKSRWQQGNVFSCSVMHEALHNHYTQESLSLSPGK | HC; DLL3.34 |
| 294 | SDVQLQESGPGLVKPSQSLSLTCSVTGYSITSAYYWNWIRQFPGN KLEWMGYISDVGSNNYNPSLKNRISITRDTFKNQFFLKLNSVTTED TATYFCTRDQVFAYWGQGTLVTVSAASTKGPSVFPLAPSSKSTSG GTAALGCLVKDYFPEPVTVSWNSGALTSGVHTFPAVLQSSGLYSL SSVVTVPSSSLGTQTYICNVNHKPSNTKVDKRVEPKSCDKTHTCP PCPAPEFEGGPSVFLFPPKPKDTLMISRTPEVTCVVVDVSHEDPEV KFNWYVDGVEVHNAKTKPREEQYNSTYRVVSVLTVLHQDWLNGK EYKCKVSNKALPASIEKTISKAKGQPREPQVCTLPPSRDELTKNQV SLTCLVEGFYPSDIAVEWESNGQPENNYKTTPPVLDSDGSFFLYS DLTVDKSRWQQGNVFSCSVMHEALHNHYTQESLSLSPGK | HC; DLL3.35 |
| 295 | DIQLTQSPSFLSASVGDRVTITCKASQNVGIAVAWYQQKPGKAPKL LIYAASNRYTGVPSRFSGSGSGTEFTLTISSLQPEDFATYYCQQYS TYPYTFGQGTKLEIKRTVAAPSVFIFPPSDEQLKSGTASVVCLLNNF YPREAKVQWKVDNALQSGNSQESVTEQDSKDSTYSLSSTLTLSKA DYEKHKVYACEVTHQGLSSPVTKSFNRGEC | LC; DLL3.3 |
| 296 | DIQMTQSPSFLSASVGDRVTITCKASQNVGTNVAWYQQKPGKAPK PLIYSTSYRYSGVPSRFSGSGSGTEFTLTISSLQPEDFATYYCQQY NNYPLTFGGGTKVEIKRTVAAPSVFIFPPSDEQLKSGTASVVCLLN NFYPREAKVQWKVDNALQSGNSQESVTEQDSKDSTYSLSSTLTLS KADYEKHKVYACEVTHQGLSSPVTKSFNRGEC | LC; DLL3.4 |
| 297 | DIQMTQSPSSLSASVGDRVTITCKSSQSLLHSDAKTFLYWYQQKP GKAPKLLIYEVSNRFSGVPSRFSGSGSGTDFTLTISSLQPEDFATY YCLQGERLPFTFGQGTKVEIKRTVAAPSVFIFPPSDEQLKSGTASV VCLLNNFYPREAKVQWKVDNALQSGNSQESVTEQDSKDSTYSLS STLTLSKADYEKHKVYACEVTHQGLSSPVTKSFNRGEC | LC; DLL3.26 |
| 298 | DIQMTQSPSTLSASVGDRVTITCKASQNVGTNVAWYQQKPGKAPK ALIYSASYRYSGVPSRFSGSGSGTEFTLTISSLQPDDFATYYCQQY NSYPFTFGQGTKLEIKRTVAAPSVFIFPPSDEQLKSGTASVVCLLN NFYPREAKVQWKVDNALQSGNSQESVTEQDSKDSTYSLSSTLTLS KADYEKHKVYACEVTHQGLSSPVTKSFNRGEC | LC; DLL3.27 |
| 299 | DIVMTQAAFSNPVTVGTSASISCRSSKSLLHSNGITYLYWYLQKPG QSPQLLIYQMSNLASGVPDRFSSSGSGTDFTLRISRVEAEDVGVY YCAQNLELPWTFGGGTKLEIKRTVAAPSVFIFPPSDEQLKSGTASV VCLLNNFYPREAKVQWKVDNALQSGNSQESVTEQDSKDSTYSLS STLTLSKADYEKHKVYACEVTHQGLSSPVTKSFNRGEC | LC; DLL3.1 |

TABLE 20-continued

SEQUENCES

| Seq ID | sequence | name |
|---|---|---|
| 300 | DIVMTQSPKFMSTSVGDRVSVTCKASQNVGTNVAWYQQKPGQSP KALIYSASYRYSGVPDRFTGSGSGTDFTLTFSSVQSEDLAEYFCQ QYNNYPLTFGGGTKLEIKRRTVAAPSVFIFPPSDEQLKSGTASVVC LLNNFYPREAKVQWKVDNALQSGNSQESVTEQDSKDSTYSLSSTL TLSKADYEKHKVYACEVTHQGLSSPVTKSFNRGEC | LC; DLL3.2 |
| 301 | DIVMTQSPLSLPVTPGEPASISCKSSQSLLHSDAKTFLYWYLQKPG QSPQLLIYEVSNRFSGVPDRFSGSGSGTDFTLKISRVEAEDVGVYY CLQGRELPFTFGQGTKVEIKRTVAAPSVFIFPPSDEQLKSGTASVV CLLNNFYPREAKVQWKVDNALQSGNSQESVTEQDSKDSTYSLSS TLTLSKADYEKHKVYACEVTHQGLSSPVTKSFNRGEC | LC; DLL3.8 |
| 302 | DIVMTQSPLSLPVTPGEPASISCKSSQSLLHSDGKTFLYWYLQKPG QSPQLLIYEVSNRFSGVPDRFSGSGSGTDFTLKISRVEAEDVGVYY CLQGERLPFTFGQGTKVEIKRTVAAPSVFIFPPSDEQLKSGTASVV CLLNNFYPREAKVQWKVDNALQSGNSQESVTEQDSKDSTYSLSS TLTLSKADYEKHKVYACEVTHQGLSSPVTKSFNRGEC | LC; DLL3.9 |
| 303 | DIVMTQSPLSLPVTPGEPASISCRSSQSLLHSDAKTFLDWYLQKPG QSPQLLIYEVSNRASGVPDRFSGSGSGTDFTLKISRVEAEDVGVYY CLQGRELPFTFGQGTKVEIKRTVAAPSVFIFPPSDEQLKSGTASVV CLLNNFYPREAKVQWKVDNALQSGNSQESVTEQDSKDSTYSLSS TLTLSKADYEKHKVYACEVTHQGLSSPVTKSFNRGEC | LC; DLL3.22, DLL3.23, DLL3.24, DLL3.25 |
| 304 | DIVMTQSPLSLPVTPGEPASISCRSSQSLLHSDGKTFLDWYLQKPG QSPQLLIYEVSNRASGVPDRFSGSGSGTDFTLKISRVEAEDVGVYY CLQGERLPFTFGQGTKVEIKRTVAAPSVFIFPPSDEQLKSGTASVV CLLNNFYPREAKVQWKVDNALQSGNSQESVTEQDSKDSTYSLSS TLTLSKADYEKHKVYACEVTHQGLSSPVTKSFNRGEC | LC; DLL3.5, DLL3.15, DLL3.16, DLL3.17 |
| 305 | DIVMTQTPLSLSVTPGQPASISCKSSQSLLHSDAKTFLYWYLQKPG QPPQLLIYEVSNRFSGVPDRFSGSGSGTDFTLKISRVEAEDVGVYY CLQGRELPFTFGPGTKVEIKRTVAAPSVFIFPPSDEQLKSGTASVV CLLNNFYPREAKVQWKVDNALQSGNSQESVTEQDSKDSTYSLSS TLTLSKADYEKHKVYACEVTHQGLSSPVTKSFNRGEC | LC DLL3.18, DLL3.19, DLL3.20, DLL3.21 |
| 306 | DIVMTQTPLSLSVTPGQPASISCKSSQSLLHSDAKTFLYWYLQKPG QPPQLLIYEVSNRFSGVPDRFSGSGSGTDFTLKISRVEAEDVGVYY CLQGRELPFTFGPGTKVEIKSTFGQGTKVEIKRTVAAPSVFIFPPSD EQLKSGTASVVCLLNNFYPREAKVQWKVDNALQSGNSQESVTEQ DSKDSTYSLSSTLTLSKADYEKHKVYACEVTHQGLSSPVTKSFNR GEC | LC; DLL3.11, DLL3.12, DLL3.13, DLL3.14 |
| 307 | DIVMTQTPLSLSVTPGQPASISCKSSQSLLHSDGKTFLYWYLQKPG QPPQLLIYEVSNRFSGVPDRFSGSGSGTDFTLKISRVEAEDVGVYY CLQGERLPFTFGPGTKVEIKRTVAAPSVFIFPPSDEQLKSGTASVV CLLNNFYPREAKVQWKVDNALQSGNSQESVTEQDSKDSTYSLSS TLTLSKADYEKHKVYACEVTHQGLSSPVTKSFNRGEC | LC DLL3.32, DLL3.33 |
| 308 | DIVMTQTPLSLSVTPGQPASISCKSSQSLLHSDGKTFLYWYLQKPG QPPQLLIYEVSNRFSGVPDRFSGSGSGTDFTLKISRVEAEDVGVYY CLQGERLPFTFGPGTKVEIKSTFGQGTKVEIKRTVAAPSVFIFPPSD EQLKSGTASVVCLLNNFYPREAKVQWKVDNALQSGNSQESVTEQ DSKDSTYSLSSTLTLSKADYEKHKVYACEVTHQGLSSPVTKSFNR GEC | LC; DLL3.10, DLL3.31 |
| 309 | DIVMTQTPLSLSVTPGQPASISCKSSQSLLHSDGKTFLYWYLQKPG QPPQLLIYEVSNRFSGVPDRFSGSGSGTDFTLKISRVEAEDVGVYY CLQGIHLPFTFGPGTKVEIKRTVAAPSVFIFPPSDEQLKSGTASVVC LLNNFYPREAKVQWKVDNALQSGNSQESVTEQDSKDSTYSLSSTL TLSKADYEKHKVYACEVTHQGLSSPVTKSFNRGEC | LC; DLL3.29, DLL3.30, DLL3.36 |
| 310 | DIVMTQTPLSLSVTPGQPASISCKSSQSLLHSDGKTFLYWYLQKPG QPPQLLIYEVSNRFSGVPDRFSGSGSGTDFTLKISRVEAEDVGVYY CLQGIHLPFTFGPGTKVEIKSTFGQGTKVEIKRTVAAPSVFIFPPSD EQLKSGTASVVCLLNNFYPREAKVQWKVDNALQSGNSQESVTEQ DSKDSTYSLSSTLTLSKADYEKHKVYACEVTHQGLSSPVTKSFNR GEC | LC; DLL3.29.1 |
| 311 | DTVLTQSPASLAVSLGQRATISCRASESVHSYGNSLIHWYQQKPG QPPRLLIYRASNLESGIPARFSGSGSRTDFTLTINPVEADDVATYYC QQTNEDPLTFGAGTKLELKRTVAAPSVFIFPPSDEQLKSGTASVVC LLNNFYPREAKVQWKVDNALQSGNSQESVTEQDSKDSTYSLSSTL TLSKADYEKHKVYACEVTHQGLSSPVTKSFNRGEC | LC; DLL3.34 |

TABLE 20-continued

SEQUENCES

| Seq ID | sequence | name |
|---|---|---|
| 312 | EIVLTQSPGTLSLSPGERVTLSCRASQRVNNNYLAWYQQRPGQAP RLLIYGASSRATGIPDRFSGSGSGTDFTLTISRLEPEDFAVYYCQQ YDRSPLTFGGGTKLEIKRTVAAPSVFIFPPSDEQLKSGTASVVCLLN NFYPREAKVQWKVDNALQSGNSQESVTEQDSKDSTYSLSSTLTLS KADYEKHKVYACEVTHQGLSSPVTKSFNRGEC | LC; DLL3.28 |
| 313 | QIVLTQSPAIMSASPGEKVTMTCSASSSVSYMHWYQQKSGTSPKR WIYDTSKLASGVPARFSGSGSGTSYSLTISSMEAEDAATYYCQQW SSNPLTFGAGTKLELKRTVAAPSVFIFPPSDEQLKSGTASVVCLLN NFYPREAKVQWKVDNALQSGNSQESVTEQDSKDSTYSLSSTLTLS KADYEKHKVYACEVTHQGLSSPVTKSFNRGEC | LC; DLL3.35 |
| 341 | QVQLVQSGAEVKKPGASVKVSCKASDYTFSNYYIEWVRQAPGQG LEWMGEILPGNGNTVYNEKFKDRVTMTVDTSTSTAYMELRSLRSD DTAVYYCARWGDYALFANWGQGTLVTVSSGGGGSGGGGSGGG GSDIQMTQSPSTLSASVGDRVTITCKASQNVGTNVAWYQQKPGK APKALIYSASYRYSGVPSRFSGSGSGTEFTLTISSLQPDDFATYYC QQYNSYPFTFGQGTKLEIKSGGGSEVQLVESGGGLVQPGGSLRL SCAASGFTFSTYAMNWVRQAPGKGLEWVGRIRSKYNNYATYYAD SVKGRFTISRDDSKNTLYLQMNSLRAEDTAVYYCVRHGNFGDSYV SWFAYWGQGTLVTVSSGKPGSGKPGSGKPGSGKPGSQAVVTQE PSLTVSPGGTVTLTCGSSTGAVTTSNYANWVQQKPGKSPRGLIGG TNKRAPGVPARFSGSLLGGKAALTISGAQPEDEADYYCALWYSNH WVFGGGTKLTVLEPKSSDKTHTCPPCPAPEFEGGPSVFLFPPKPK DTLMISRTPEVTCVVVDVSHEDPEVKFNWYVDGVEVHNAKTKPRE EQYNSTYRVVSVLTVLHQDWLNGKEYKCKVSNKALPASIEKTISKA KGQPREPQVYTLPPCRKKLTKNQVSLTCLVKGFYPSDIAVEWESN GQPENNYKTTPPVLKDGSFFLYSKLTVDKSRWQQGNVFSCSVM HEALHNHYTQKSLSLSPGK | DLL3Scfv-CD3Scfv-Fv |
| 342 | QVQLVQSGAEVKKPGASVKVSCKATDYIFSNYYIEWVRQAPGQGL EWMGEILPGTGNTVYNEKFKDRVTMTVDTSTSTVYMELSSLRSED TAVYYCARWGDYALFANWGQGTLVTVSSGGGGSGGGGSGGGG SDIQMTQSPSTLSASVGDRVTITCKASQNVGTNVAWYQQKPGKAP KALIYSASYRYSGVPSRFSGSGSGTEFTLTISSLQPDDFATYYCQQ YNSYPFTFGQGTKLEIKSGGGSEVQLVESGGGLVQPGGSLRLSCA ASGFTFSTYAMNWVRQAPGKGLEWVGRIRSKYNNYATYYADSVK GRFTISRDDSKNTLYLQMNSLRAEDTAVYYCVRHGNFGDSYVSW FAYWGQGTLVTVSSGKPGSGKPGSGKPGSGKPGSQAVVTQEPS LTVSPGGTVTLTCGSSTGAVTTSNYANWVQQKPGKSPRGLIGGTN KRAPGVPARFSGSLLGGKAALTISGAQPEDEADYYCALWYSNHW VFGGGTKLTVLEPKSSDKTHTCPPCPAPEFEGGPSVFLFPPKPKD TLMISRTPEVTCVVVDVSHEDPEVKFNWYVDGVEVHNAKTKPREE QYNSTYRVVSVLTVLHQDWLNGKEYKCKVSNKALPASIEKTISKAK GQPREPQVYTLPPCRKKLTKNQVSLTCLVKGFYPSDIAVEWESNG QPENNYKTTPPVLKDGSFFLYSKLTVDKSRWQQGNVFSCSVMH EALHNHYTQKSLSLSPGK | DLL3Scfv-CD3Scfv-Fv |
| 343 | QVQLVQSGAEVKKPGASVKVSCKASGYTFTDYFMNWVRQAPGQ GLEWMGVINPYNDITIYNQKFQGRVTMTVDRSTSTVYMELSSLRS EDTAVYYCAREGVLYDGYYEGAYWGQGTLVTVSSGGGGSGGGG SGGGGSDIQLTQSPSFLSASVGDRVTITCKASQNVGIAVAWYQQK PGKAPKLLIYAASNRYTGVPSRFSGSGSGTEFTLTISSLQPEDFAT YYCQQYSTYPYTFGQGTKLEIKSGGGSEVQLVESGGGLVQPGGS LRLSCAASGFTFSTYAMNWVRQAPGKGLEWVGRIRSKYNNYATY YADSVKGRFTISRDDSKNTLYLQMNSLRAEDTAVYYCVRHGNFGD SYVSWFAYWGQGTLVTVSSGKPGSGKPGSGKPGSGKPGSQAVV TQEPSLTVSPGGTVTLTCGSSTGAVTTSNYANWVQQKPGKSPRG LIGGTNKRAPGVPARFSGSLLGGKAALTISGAQPEDEADYYCALW YSNHWVFGGGTKLTVLEPKSSDKTHTCPPCPAPEFEGGPSVFLFP PKPKDTLMISRTPEVTCVVVDVSHEDPEVKFNWYVDGVEVHNAKT KPREEQYNSTYRVVSVLTVLHQDWLNGKEYKCKVSNKALPASIEK TISKAKGQPREPQVYTLPPCRKKLTKNQVSLTCLVKGFYPSDIAVE WESNGQPENNYKTTPPVLKDGSFFLYSKLTVDKSRWQQGNVFS CSVMHEALHNHYTQKSLSLSPGK | DLL3Scfv-CD3Scfv-Fv |
| 344 | QVQLVQSGAEVKKPGASVKVSCKASGYTFTDYFMNWVRQAPGQ CLEWMGVINPYNDITIYNQKFQGRVTMTVDRSTSTVYMELSSLRS EDTAVYYCAREGVLYDGYYEGAYWGQGTLVTVSSGGGGSGGGG SGGGGSDIQLTQSPSFLSASVGDRVTITCKASQNVGIAVAWYQQK PGKAPKLLIYAASNRYTGVPSRFSGSGSGTEFTLTISSLQPEDFAT YYCQQYSTYPYTFGCGTKLEIKSGGGSEVQLVESGGGLVQPGGS LRLSCAASGFTFSTYAMNWVRQAPGKGLEWVGRIRSKYNNYATY YADSVKGRFTISRDDSKNTLYLQMNSLRAEDTAVYYCVRHGNFGD SYVSWFEYWGQGTLVTVSSGKPGSGKPGSGKPGSGKPGSQAVV TQEPSLTVSPGGTVTLTCGSSTGAVTTSNYANWVQQKPGKSPRG | DLL3Scfv-CD3Scfv-Fv |

TABLE 20-continued

SEQUENCES

| Seq ID | sequence | name |
|---|---|---|
| | LIGGTNKRAPGVPARFSGSLLGGKAALTISGAQPEDEADYYCALW YSNHWVFGGGTKLTVLEPKSSDKTHTCPPCPAPEFEGGPSVFLFP PKPKDTLMISRTPEVTCVVVDVSHEDPEVKFNWYVDGVEVHNAKT KPREEQYNSTYRVVSVLTVLHQDWLNGKEYKCKVSNKALPASIEK TISKAKGQPREPQVYTLPPCRKKLTKNQVSLTCLVKGFYPSDIAVE WESNGQPENNYKTTPPVLKSDGSFFLYSKLTVDKSRWQQGNVFS CSVMHEALHNHYTQKSLSLSPGK | |
| 345 | QVQLVQSGAEVKKPGASVKVSCKATDYIFSNYYIEWVRQAPGQGL EWMGEILPGTGNTVYNEKFKDRVTMTVDTSTSTVYMELSSLRSED TAVYYCARWGDYALFANWGQGTLVTVSSGGGGGGGGSGGGG SDIQMTQSPSFLSASVGDRVTITCKASQNVGTNVAWYQQKPGKAP KPLIYSTSYRYSGVPSRFSGSGSGTEFTLTISSLQPEDFATYYCQQ YNNYPLTFGGGTKVEIKSGGGSEVQLVESGGGLVQPGGSLRLSC AASGFTFSTYAMNWVRQAPGKGLEWVGRIRSKYNNYATYYADSV KGRFTISRDDSKNTLYLQMNSLRAEDTAVYYCVRHGNFGDSYVS WFAYWGQGTLVTVSSGKPGSGKPGSGKPGSGKPGSQAVVTQEP SLTVSPGGTVTLTCGSSTGAVTTSNYANWVQQKPGKSPRGLIGGT NKRAPGVPARFSGSLLGGKAALTISGAQPEDEADYYCALWYSNH WVFGGGTKLTVLEPKSSDKTHTCPPCPAPEFEGGPSVFLFPPKPK DTLMISRTPEVTCVVVDVSHEDPEVKFNWYVDGVEVHNAKTKPRE EQYNSTYRVVSVLTVLHQDWLNGKEYKCKVSNKALPASIEKTISKA KGQPREPQVYTLPPCRKKLTKNQVSLTCLVKGFYPSDIAVEWESN GQPENNYKTTPPVLKSDGSFFLYSKLTVDKSRWQQGNVFSCSVM HEALHNHYTQKSLSLSPGK | DLL3Scfv-CD3Scfv-Fv |
| 346 | QVQLVQSGAEVKKPGASVKVSCKASGYTFTDYFMNWVRQAPGQ GLEWMGVINPYNDITIYNQKFQGRVTMTVDRSTSTVYMELSSLRS EDTAVYYCAREGVLYDGYYEGAYWGQGTLVTVSSGGGGSGGGG SGGGGSDIQLTQSPSFLSASVGDRVTITCKASQNVGIAVAWYQQK PGKAPKLLIYAASNRYTGVPSRFSGSGSGTEFTLTISSLQPEDFAT YYCQQYSTYPYTFGQGTKLEIKSGGGSEVQLVESGGGLVQPGGS LRLSCAASGFTFSTYAMNWVRQAPGKGLEWVGRIRSKYNNYATY YADSVKGRFTISRDDSKNTLYLQMNSLRAEDTAVYYCVRHGNFGD SYVSWFAYWGQGTLVTVSSGKPGSGKPGSGKPGSGKPGSQAVV TQEPSLTVSPGGTVTLTCGSSTGAVTTSNYANWVQQKPGKSPRG LIGGTNKRAPGVPARFSGSLLGGKAALTISGAQPEDEADYYCALW YSNHWVFGGGTKLTVLEPKSSDKTHTCPPCPAPEFEGGPSVFLFP PKPKDTLMISRTPEVTCVVVDVSHEDPEVKFNWYVDGVEVHNAKT KPREEQYNSTYRVVSVLTVLHQDWLNGKEYKCKVSNKALPASIEK TISKAKGQPREPQVYTLPPCRKKLTKNQVSLTCLVKGFYPSDIAVE WESNGQPENNYKTTPPVLKSDGSFFLYSKLTVDKSRWQQGNVFS CSVMHEALHNHYTQKSLSLSPGK | DLL3Scfv-CD3Scfv-Fv |
| 347 | QVQLVQSGAEVKKPGASVKVSCKASGYTFTDYFMNWVRQAPGQ GLEWMGVINPYNDITIYNQKFQGRVTMTVDRSTSTVYMELSSLRS EDTAVYYCAREGVLYDGYYEGAYWGQGTLVTVSSGGGGSGGGG SGGGGSDIQLTQSPSFLSASVGDRVTITCKASQNVGIAVAWYQQK PGKAPKLLIYAASNRYTGVPSRFSGSGSGTEFTLTISSLQPEDFAT YYCQQYSTYPYTFGQGTKLEIKSGGGSEVQLVESGGGLVQPGGS LRLSCAASGFTFSTYAMNWVRQAPGKGLEWVGRIRSKYNNYATY YADSVKGRFTISRDDSKNTLYLQMNSLRAEDTAVYYCVRHGNFGD SYVSWFEYWGQGTLVTVSSGKPGSGKPGSGKPGSGKPGSQAVV TQEPSLTVSPGGTVTLTCGSSTGAVTTSNYANWVQQKPGKSPRG LIGGTNKRAPGVPARFSGSLLGGKAALTISGAQPEDEADYYCALW YSNHWVFGGGTKLTVLEPKSSDKTHTCPPCPAPEFEGGPSVFLFP PKPKDTLMISRTPEVTCVVVDVSHEDPEVKFNWYVDGVEVHNAKT KPREEQYNSTYRVVSVLTVLHQDWLNGKEYKCKVSNKALPASIEK TISKAKGQPREPQVYTLPPCRKKLTKNQVSLTCLVKGFYPSDIAVE WESNGQPENNYKTTPPVLKSDGSFFLYSKLTVDKSRWQQGNVFS CSVMHEALHNHYTQKSLSLSPGK | DLL3Scfv-CD3Scfv-Fv |
| 348 | QVQLVQSGAEVKKPGASVKVSCKASGYTFTDYFMNWVRQAPGQ GLEWMGVINPYNDITIYNQKFQGRVTMTVDRSTSTVYMELSSLRS EDTAVYYCAREGVLYDGYYEGAYWGQGTLVTVSSGGGGSGGGG SGGGGSDIQLTQSPSFLSASVGDRVTITCKASQNVGIAVAWYQQK PGKAPKLLIYAASNRYTGVPSRFSGSGSGTEFTLTISSLQPEDFAT YYCQQYSTYPYTFGQGTKLEIKSGGGSEVQLVESGGGLVQPGGS LRLSCAASGFTFSTYAMNWVRQAPGKGLEWVGRIRSKYNNYATY YADSVKGRFTISRDDSKNTLYLQMNSLRAEDTAVYYCVRHGNFGD SYVSWFNYWGQGTLVTVSSGKPGSGKPGSGKPGSGKPGSQAVV TQEPSLTVSPGGTVTLTCGSSTGAVTTSNYANWVQQKPGKSPRG LIGGTNKRAPGVPARFSGSLLGGKAALTISGAQPEDEADYYCALW YSNHWVFGGGTKLTVLEPKSSDKTHTCPPCPAPEFEGGPSVFLFP PKPKDTLMISRTPEVTCVVVDVSHEDPEVKFNWYVDGVEVHNAKT KPREEQYNSTYRVVSVLTVLHQDWLNGKEYKCKVSNKALPASIEK | DLL3Scfv-CD3Scfv-Fv |

TABLE 20-continued

SEQUENCES

| Seq ID | sequence | name |
|---|---|---|
|  | TISKAKGQPREPQVYTLPPCRKKLTKNQVSLTCLVKGFYPSDIAVE<br>WESNGQPENNYKTTPPVLKSDGSFFLYSKLTVDKSRWQQGNVFS<br>CSVMHEALHNHYTQKSLSLSPGK |  |
| 349 | EVQLVQSGAEVKKPGESLKISCKGSGYEFSSHWMNWVRQMPGK<br>CLEWMGQIYPGDGDINYNEKFRGQVTISADKSISTAYLQWSSLKAS<br>DTAMYYCARHGNYVMDYWGQGTLVTVSSGGGGSGGGGSGGGG<br>SGGGGSIQLTQSPSFLSASVGDRVTITCSASSSVSYMFWYQQKPG<br>KAPKPWIYRTSNLASGVPSRFSGSGSGTEFTLTISSLQPEDFATYY<br>CQQFHDYPRTFGCGTKVEIKSGGGSEVQLVESGGGLVQPGGSLR<br>LSCAASGFTFSTYAMNWVRQAPGKGLEWVGRIRSKYNNYATYYA<br>DSVKGRFTISRDDSKNTLYLQMNSLRAEDTAVYYCVRHGNFGDSY<br>VSWFEYWGQGTLVTVSSGKPGSGKPGSGKPGSGKPGSQAVVTQ<br>EPSLTVSPGGTVTLTCGSSTGAVTTSNYANWVQQKPGKSPRGLIG<br>GTNKRAPGVPARFSGSLLGGKAALTISGAQPEDEADYYCALWYSN<br>HWVFGGGTKLTVLEPKSSDKTHTCPPCPAPEFEGGPSVFLFPPKP<br>KDTLMISRTPEVTCVVVDVSHEDPEVKFNWYVDGVEVHNAKTKPR<br>EEQYNSTYRVVSVLTVLHQDWLNGKEYKCKVSNKALPASIEKTISK<br>AKGQPREPQVYTLPPCRKKLTKNQVSLTCLVKGFYPSDIAVEWES<br>NGQPENNYKTTPPVLKSDGSFFLYSKLTVDKSRWQQGNVFSCSV<br>MHEALHNHYTQKSLSLSPGK | Muc17scfv-<br>CD3scfv |
| 350 | EVQLVQSGAEVKKPGESLKISCKGSGYEFSSHWMNWVRQMPGK<br>GLEWMGQIYPGDGDINYNEKFRGQVTISADKSISTAYLQWSSLKA<br>SDTAMYYCARHGNYVMDYWGQGTLVTVSSGGGGSGGGGSGGG<br>GSGGGGSIQLTQSPSFLSASVGDRVTITCSASSSVSYMFWYQQKP<br>GKAPKPWIYRTSNLASGVPSRFSGSGSGTEFTLTISSLQPEDFATY<br>YCQQFHDYPRTFGGGTKVEIKSGGGSEVQLVESGGGLVQPGGSL<br>RLSCAASGFTFSTYAMNWVRQAPGKGLEWVGRIRSKYNNYATYY<br>ADSVKGRFTISRDDSKNTLYLQMNSLRAEDTAVYYCVRHGNFGDS<br>YVSWFAYWGQGTLVTVSSGKPGSGKPGSGKPGSGKPGSQAVVT<br>QEPSLTVSPGGTVTLTCGSSTGAVTTSNYANWVQQKPGKSPRGLI<br>GGTNKRAPGVPARFSGSLLGGKAALTISGAQPEDEADYYCALWYS<br>NHWVFGGGTKLTVLEPKSSDKTHTCPPCPAPEFEGGPSVFLFPPK<br>PKDTLMISRTPEVTCVVVDVSHEDPEVKFNWYVDGVEVHNAKTKP<br>REEQYNSTYRVVSVLTVLHQDWLNGKEYKCKVSNKALPASIEKTIS<br>KAKGQPREPQVYTLPPCRKKLTKNQVSLTCLVKGFYPSDIAVEWE<br>SNGQPENNYKTTPPVLKSDGSFFLYSKLTVDKSRWQQGNVFSCS<br>VMHEALHNHYTQKSLSLSPGK | Muc17scfv-<br>CD3scfv |
| 351 | QVQLQQWGAGLLKPSETLSLTCAVYGGSFSGYYWSWIRQPPGKC<br>LEWIGDIDASGSTKYNPSLKSRVTISLDTSKNQFSLKLNSVTAADTA<br>VYFCARKKYSTVWSYFDNWGQGTLVTVSSGGGGSGGGGSGGG<br>GSSYELTQPSSVSVPPGQTASITCSGDKLGDKYASWYQQKPGQS<br>PVLVIYQDRKRPSGVPERFSGSNSGNTATLTISGTQAMDEADYYC<br>QAWGSSTAVFGCGTKLTVLSGGGGSEVQLVESGGGLVQPGGSL<br>KLSCAASGFTFNKYAMNWVRQAPGKGLEWVARIRSKYNNYATYY<br>ADSVKDRFTISRDDSKNTAYLQMNNLKTEDTAVYYCVRHGNFGNS<br>YISYWAYWGQGTLVTVSSGGGGSGGGGSGGGGSQTVVTQEPSL<br>TVSPGGTVTLTCGSSTGAVTSGNYPNWVQQKPGQAPRGLIGGTK<br>FLAPGTPARFSGSLLGGKAALTLSGVQPEDEAEYYCVLWYSNRW<br>VFGGGTKLTVLGGGGDKTHTCPPCPAPELLGGPSVFLFPPKPKDT<br>LMISRTPEVTCVVVDVSHEDPEVKFNWYVDGVEVHNAKTKPCEEQ<br>YGSTYRCVSVLTVLHQDWLNGKEYKCKVSNKALPAPIEKTISKAKG<br>QPREPQVYTLPPSREEMTKNQVSLTCLVKGFYPSDIAVEWESNGQ<br>PENNYKTTPPVLDSDGSFFLYSKLTVDKSRWQQGNVFSCSVMHE<br>ALHNHYTQKSLSLSPGKGGGGSGGGGSGGGGSGGGGSGGGGS<br>GGGGSDKTHTCPPCPAPELLGGPSVFLFPPKPKDTLMISRTPEVT<br>CVVVDVSHEDPEVKFNWYVDGVEVHNAKTKPCEEQYGSTYRCVS<br>VLTVLHQDWLNGKEYKCKVSNKALPAPIEKTISKAKGQPREPQVYT<br>LPPSREEMTKNQVSLTCLVKGFYPSDIAVEWESNGQPENNYKTTP<br>PVLDSDGSFFLYSKLTVDKSRWQQGNVF<br>SCSVMHEALHNHYTQKSLSLSPGK | Muc17scfv-<br>CD3scfv |
| 352 | QVQLVESGGGVVQPGRSLRLSCAASGFTFSNHGMHWVRQAPGK<br>CLEWVAGIWSEGSNKYYADAVKGRFTISRDNSKNTLYLQMNSLRA<br>EDTAVYYCARATYTTGWSYFDYWGQGTLVTVSSGGGGSGGGGS<br>GGGGSSYELTQPPSVSVSPGQTASITCSGDKLGDKYASWYQQKS<br>GQSPV<br>LVIYQDAKRPSGIPERFSGSNSGNTATLTISGTQAMDEADYYCQAF<br>HQSTWVFGCGTQLT<br>VLSGGGGSEVQLVESGGGLVQPGGSLKLSCAASGFTFNKYAMN<br>WVRQAPGKGLEWVARIR<br>SKYNNYATYYADSVKDRFTISRDDSKNTAYLQMNNLKTEDTAVYY<br>CVRHGNFGNSYISYW | Muc17scfv-<br>CD3scfv |

TABLE 20-continued

SEQUENCES

| Seq ID | sequence | name |
|---|---|---|
|  | AYWGQGTLVTVSSGGGGSGGGGSGGGGSQTVVTQEPSLTVSPG GTVTLTCGSSTGAVTSG NYPNWVQQKPGQAPRGLIGGTKFLAPGTPARFSGSLLGGKAALTL SGVQPEDEAEYYCVL WYSNRWVFGGGTKLTVLGGGGDKTHTCPPCPAPELLGGPSVFLF PPKPKDTLMISRTPEV TCVVVDVSHEDPEVKFNWYVDGVEVHNAKTKPCEEQYGSTYRCV SVLTVLHQDWLNGKEY KCKVSNKALPAPIEKTISKAKGQPREPQVYTLPPSREEMTKNQVSL TCLVKGFYPSDIAVEWESNGQPENNYKTTPPVLDSDGSFFLYSKL TVDKSRWQQGNVFSCSVMHEALHNHYTQKSLSLSPGKGGGGSG GGGSGGGGSGGGGSGGGGSGGGGSDKTHTCPPCPAPELLGGP SVFLFPPKPKDTLMISRTPEVTCVVVDVSHEDPEVKFNWYVDGVE VHNAKTKPCEEQYGSTYRCVSVLTVLHQDWLNGKEYKCKVSNKA LPAPIEKTISKAKGQPREPQVYTLPPSREEMTKNQVSLTCLVKGFY PSDIAVEWESNGQPENNYKTTPPVLDSDGSFFLYSKLTVDKSRWQ QGNVFSCSVMHEALHNHYTQKSLSLSPGK |  |
| 353 | QVQLVQSGAEVKKPGSSVKVSCKASGYTFTSYWLNWVRQAPGQ GLEWMGMIHPSDSESRLNQKFKDRVTITADKSTSTAYMELSSLRS EDTAVYYCARQGIITSVQEFAYWGQGTLVTVSSGGGGSGGGGSG GGGSGGGGSIQMTQSPSSLSASVGDRVTITCSASSSVNYIFWYQQ KPGKAPKLLIYRTSNLASGVPSRFSGSGSGTDFTLTISSLQPEDFAT YYCQQYHSYPLTFGGGTKVEIKSGGGGSEVQLVESGGGLVQPGG SLRLSCAASGFTFSTYAMNWVRQAPGKGLEWVGRIRSKYNNYAT YYADSVKGRFTISRDDSKNTLYLQMNSLRAEDTAVYYCVRHGNFG DSYVSWFEYWGQGTLVTVSSGKPGSGKPGSGKPGSGKPGSQAV VTQEPSLTVSPGGTVTLTCGSSTGAVTTSNYANWVQQKPGKSPR GLIGGTNKRAPGVPARFSGSLLGGKAALTISGAQPEDEADYYCAL WYSNHWVFGGGTKLTVLEPKSSDKTHTCPPCPAPEFEGGPSVFL FPPKPKDTLMISRTPEVTCVVVDVSHEDPEVKFNWYVDGVEVHNA KTKPREEQYNSTYRVVSVLTVLHQDWLNGKEYKCKVSNKALPASI EKTISKAKGQPREPQVYTLPPCRKKLTKNQVSLTCLVKGFYPSDIA VEWESNGQPENNYKTTPPVLKSDGSFFLYSKLTVDKSRWQQGNV FSCSVMHEALHNHYTQKSLSLSPGK | Muc17scfv-CD3scfv |
| 354 | QVQLVQSGAEVKKPGSSVKVSCKASGYTFTSYWLNWVRQAPGQ GLEWMGMIHPSDSESRLNQKFKDRVTITADKSTSTAYMELSSLRS EDTAVYYCARQGIITSVQEFAYWGQGTLVTVSSGGGGSGGGGSG GGGSGGGGSIQMTQSPSSLSASVGDRVTITCSASSSVNYIFWYQQ KPGKAPKLLIYRTSNLASGVPSRFSGSGSGTDFTLTISSLQPEDFAT YYCQQYHSYPLTFGGGTKVEIKSGGGSEVQLVESGGGLVQPGGS LRLSCAASGFTFSTYAMNWVRQAPGKGLEWVGRIRSKYNNYATY YADSVKGRFTISRDDSKNTLYLQMNSLRAEDTAVYYCVRHGNFGD SYVSWFEYWGQGTLVTVSSGKPGSGKPGSGKPGSGKPGSQAVV TQEPSLTVSPGGTVTLTCGSSTGAVTTSNYANWVQQKPGKSPRG LIGGTNKRAPGVPARFSGSLLGGKAALTISGAQPEDEADYYCALW YSNHWVFGGGTKLTVLEPKSSDKTHTCPPCPAPEFEGGPSVFLFP PKPKDTLMISRTPEVTCVVVDVSHEDPEVKFNWYVDGVEVHNAKT KPREEQYNSTYRVVSVLTVLHQDWLNGKEYKCKVSNKALPASIEK TISKAKGQPREPQVYTLPPCRKKLTKNQVSLTCLVKGFYPSDIAVE WESNGQPENNYKTTPPVLKSDGSFFLYSKLTVDKSRWQQGNVFS CSVMHEALHNHYTQKSLSLSPGK | Muc17scfv-CD3scfv |
| 355 | QVQLVQSGAEVKKPGSSVKVSCKASGYTFTSYWLNWVRQAPGQ GLEWMGMIHPSDSESRLNQKFKDRVTITADKSTSTAYMELSSLRS EDTAVYYCARQGIITSVQEFAYWGQGTLVTVSSGGGGSGGGGSG GGGSGGGGSIQMTQSPSSLSASVGDRVTITCSASSSVNYIYWYQ QKPGKAPKLLIYRTSNLASGVPSRFSGSGSGTDFTLTISSLQPEDF ATYYCQQYHSYPLTFGGGTKVEIKSGGGGSEVQLVESGGGLVQP GGSLRLSCAASGFTFSTYAMNWVRQAPGKGLEWVGRIRSKYNNY ATYYADSVKGRFTISRDDSKNTLYLQMNSLRAEDTAVYYCVRHGN FGDSYVSWFEYWGQGTLVTVSSGKPGSGKPGSGKPGSGKPGSQ AVVTQEPSLTVSPGGTVTLTCGSSTGAVTTSNYANWVQQKPGKS PRGLIGGTNKRAPGVPARFSGSLLGGKAALTISGAQPEDEADYYC ALWYSNHWVFGGGTKLTVLEPKSSDKTHTCPPCPAPEFEGGPSV FLFPPKPKDTLMISRTPEVTCVVVDVSHEDPEVKFNWYVDGVEVH NAKTKPREEQYNSTYRVVSVLTVLHQDWLNGKEYKCKVSNKALPA SIEKTISKAKGQPREPQVYTLPPCRKKLTKNQVSLTCLVKGFYPSDI AVEWESNGQPENNYKTTPPVLKSDGSFFLYSKLTVDKSRWQQGN VFSCSVMHEALHNHYTQKSLSLSPGK | Muc17scfv-CD3scfv |
| 356 | QVQLVQSGAEVKKPGSSVKVSCKASGYTFTSYWbNWVRQAPGQ GLEWMGMIHPSDSETRLNQKFKDRVTITADKSTSTAYMELSSLRS EDTAVYYCARQGIITSVQEFAYWGQGTLVTVSSGGGGSGGGGSG GGGSGGGGSIQMTQSPSSLSASVGDRVTITCSASSSVNYIfWYQQ | Muc17scfv-CD3scfv |

TABLE 20-continued

SEQUENCES

| Seq ID | sequence | name |
|---|---|---|
|  | KPGKAPKLLIYRTSNLASGVPSRFSGSGSGTDFTLTISSLQPEDFAT<br>YYCQQYHSYPLTFGGGTKVEIKSGGGGSEVQLVESGGGLVQPGG<br>SLRLSCAASGFTFSTYAMNWVRQAPGKGLEWVGRIRSKYNNYAT<br>YYADSVKGRFTISRDDSKNTLYLQMNSLRAEDTAVYYCVRHGNFG<br>DSYVSWFEYWGQGTLVTVSSGKPGSGKPGSGKPGSGKPGSQAV<br>VTQEPSLTVSPGGTVTLTCGSSTGAVTTSNYANWVQQKPGKSPR<br>GLIGGTNKRAPGVPARFSGSLLGGKAALTISGAQPEDEADYYCAL<br>WYSNHWVFGGGTKLTVLEPKSSDKTHTCPPCPAPEFEGGPSVFL<br>FPPKPKDTLMISRTPEVTCVVVDVSHEDPEVKFNWYVDGVEVHNA<br>KTKPREEQYNSTYRVVSVLTVLHQDWLNGKEYKCKVSNKALPASI<br>EKTISKAKGQPREPQVYTLPPCRKKLTKNQVSLTCLVKGFYPSDIA<br>VEWESNGQPENNYKTTPPVLKSDGSFFLYSKLTVDKSRWQQGNV<br>FSCSVMHEALHNHYTQKSLSLSPGK |  |
| 357 | QVQLVQSGAEVKKPGSSVKVSCKASGYTFTSYWbNWVRQAPGQ<br>GLEWMGMIHPSDSETRLNQKFKDRVTITADKSTSTAYMELSSLRS<br>EDTAVYYCARQGIITSVQEFAYWGQGTLVTVSSGGGGSGGGGSG<br>GGGSGGGGSIQMTQSPSSLSASVGDRVTITCSASSSVNYIYWYQ<br>QKPGKAPKLLIYRTSNLASGVPSRFSGSGSGTDFTLTISSLQPEDF<br>ATYYCQQYHSYPLTFGGGTKVEIKSGGGGSEVQLVESGGGLVQP<br>GGSLRLSCAASGFTFSTYAMNWVRQAPGKGLEWVGRIRSKYNNY<br>ATYYADSVKGRFTISRDDSKNTLYLQMNSLRAEDTAVYYCVRHGN<br>FGDSYVSWFEYWGQGTLVTVSSGKPGSGKPGSGKPGSGKPGSQ<br>AVVTQEPSLTVSPGGTVTLTCGSSTGAVTTSNYANWVQQKPGKS<br>PRGLIGGTNKRAPGVPARFSGSLLGGKAALTISGAQPEDEADYYC<br>ALWYSNHWVFGGGTKLTVLEPKSSDKTHTCPPCPAPEFEGGPSV<br>FLFPPKPKDTLMISRTPEVTCVVVDVSHEDPEVKFNWYVDGVEVH<br>NAKTKPREEQYNSTYRVVSVLTVLHQDWLNGKEYKCKVSNKALPA<br>SIEKTISKAKGQPREPQVYTLPPCRKKLTKNQVSLTCLVKGFYPSDI<br>AVEWESNGQPENNYKTTPPVLKSDGSFFLYSKLTVDKSRWQQGN<br>VFSCSVMHEALHNHYTQKSLSLSPGK | Muc17scfv-<br>CD3scfv |
| 358 | QVQLVQSGAEVKKPGSSVKVSCKASGYTFTSYWMNWVRQAPGQ<br>GLEWMGMIHPSDSESRLNQKFKDRVTITADKSTSTAYMELSSLRS<br>EDTAVYYCARQGIITSVQEFAYWGQGTLVTVSSGGGGSGGGGSG<br>GGGSGGGGSIQMTQSPSSLSASVGDRVTITCSASSSVNYIfWYQQ<br>KPGKAPKLLIYRTSNLASGVPSRFSGSGSGTDFTLTISSLQPEDFAT<br>YYCQQYHSYPLTFGGGTKVEIKSGGGGSEVQLVESGGGLVQPGG<br>SLRLSCAASGFTFSTYAMNWVRQAPGKGLEWVGRIRSKYNNYAT<br>YYADSVKGRFTISRDDSKNTLYLQMNSLRAEDTAVYYCVRHGNFG<br>DSYVSWFEYWGQGTLVTVSSGKPGSGKPGSGKPGSGKPGSQAV<br>VTQEPSLTVSPGGTVTLTCGSSTGAVTTSNYANWVQQKPGKSPR<br>GLIGGTNKRAPGVPARFSGSLLGGKAALTISGAQPEDEADYYCAL<br>WYSNHWVFGGGTKLTVLEPKSSDKTHTCPPCPAPEFEGGPSVFL<br>FPPKPKDTLMISRTPEVTCVVVDVSHEDPEVKFNWYVDGVEVHNA<br>KTKPREEQYNSTYRVVSVLTVLHQDWLNGKEYKCKVSNKALPASI<br>EKTISKAKGQPREPQVYTLPPCRKKLTKNQVSLTCLVKGFYPSDIA<br>VEWESNGQPENNYKTTPPVLKSDGSFFLYSKLTVDKSRWQQGNV<br>FSCSVMHEALHNHYTQKSLSLSPG | Muc17scfv-<br>CD3scfv |
| 359 | QVQLVQSGAEVKKPGSSVKVSCKASGYTFTSYWMNWVRQAPGQ<br>GLEWMGMIHPSDSESRLNQKFKDRVTITADKSTSTAYMELSSLRS<br>EDTAVYYCARQGIITSVQEFAYWGQGTLVTVSSGGGGSGGGGSG<br>GGGSGGGGSIQMTQSPSSLSASVGDRVTITCSASSSVNYIYWYQ<br>QKPGKAPKLLIYRTSNLASGVPSRFSGSGSGTDFTLTISSLQPEDF<br>ATYYCQQYHSYPLTFGGGTKVEIKSGGGGSEVQLVESGGGLVQP<br>GGSLRLSCAASGFTFSTYAMNWVRQAPGKGLEWVGRIRSKYNNY<br>ATYYADSVKGRFTISRDDSKNTLYLQMNSLRAEDTAVYYCVRHGN<br>FGDSYVSWFEYWGQGTLVTVSSGKPGSGKPGSGKPGSGKPGSQ<br>AVVTQEPSLTVSPGGTVTLTCGSSTGAVTTSNYANWVQQKPGKS<br>PRGLIGGTNKRAPGVPARFSGSLLGGKAALTISGAQPEDEADYYC<br>ALWYSNHWVFGGGTKLTVLEPKSSDKTHTCPPCPAPEFEGGPSV<br>FLFPPKPKDTLMISRTPEVTCVVVDVSHEDPEVKFNWYVDGVEVH<br>NAKTKPREEQYNSTYRVVSVLTVLHQDWLNGKEYKCKVSNKALPA<br>SIEKTISKAKGQPREPQVYTLPPCRKKLTKNQVSLTCLVKGFYPSDI<br>AVEWESNGQPENNYKTTPPVLKSDGSFFLYSKLTVDKSRWQQGN<br>VFSCSVMHEALHNHYTQKSLSLSPGK | Muc17scfv-<br>CD3scfv |
| 360 | QVQLVQSGAEVKKPGSSVKVSCKASGYTFTSYWMNWVRQAPGQ<br>GLEWMGMIHPSDSETRLNQKFKDRVTITADKSTSTAYMELSSLRS<br>EDTAVYYCARQGIITSVQEFAYWGQGTLVTVSSGGGGSGGGGSG<br>GGGSGGGGSIQMTQSPSSLSASVGDRVTITCSASSSVNYIfWYQQ<br>KPGKAPKLLIYRTSNLASGVPSRFSGSGSGTDFTLTISSLQPEDFAT<br>YYCQQYHSYPLTFGGGTKVEIKSGGGGSEVQLVESGGGLVQPGG<br>SLRLSCAASGFTFSTYAMNWVRQAPGKGLEWVGRIRSKYNNYAT<br>YYADSVKGRFTISRDDSKNTLYLQMNSLRAEDTAVYYCVRHGNFG | Muc17scfv-<br>CD3scfv |

TABLE 20-continued

SEQUENCES

| Seq ID | sequence | name |
|---|---|---|
|  | DSYVSWFEYWGQGTLVTVSSGKPGSGKPGSGKPGSGKPGSQAV<br>VTQEPSLTVSPGGTVTLTCGSSTGAVTTSNYANWVQQKPGKSPR<br>GLIGGTNKRAPGVPARFSGSLLGKAALTISGAQPEDEADYYCAL<br>WYSNHWVFGGGTKLTVLEPKSSDKTHTCPPCPAPEFEGGPSVFL<br>FPPKPKDTLMISRTPEVTCVVVDVSHEDPEVKFNWYVDGVEVHNA<br>KTKPREEQYNSTYRVVSVLTVLHQDWLNGKEYKCKVSNKALPASI<br>EKTISKAKGQPREPQVYTLPPCRKKLTKNQVSLTCLVKGFYPSDIA<br>VEWESNGQPENNYKTTPPVLKSDGSFFLYSKLTVDKSRWQQGNV<br>FSCSVMHEALHNHYTQKSLSLSPGK |  |
| 361 | QVQLVQSGAEVKKPGSSVKVSCKASGYTFTSYWMNWVRQAPGQ<br>GLEWMGMIHPSDSETRLNQKFKDRVTITADKSTSTAYMELSSLRS<br>EDTAVYYCARQGIITSVQEFAYWGQGTLVTVSSGGGGSGGGGSG<br>GGGSGGGGSIQMTQSPSSLSASVGDRVTITCSASSSVNYIYWYQ<br>QKPGKAPKLLIYRTSNLASGVPSRFSGSGSGTDFTLTISSLQPEDF<br>ATYYCQQYHSYPLTFGGGTKVEIKSGGGGSEVQLVESGGGLVQP<br>GGSLRLSCAASGFTFSTYAMNWVRQAFGKGLEWVGRIRSKYNNY<br>ATYYADSVKGRFTISRDDSKNTLYLQMNSLRAEDTAVYYCVRHGN<br>FGDSYVSWFEYWGQGTLVTVSSGKPGSGKPGSGKPGSGKPGSQ<br>AVVTQERSLTVSPGGTVTLTCGSSTGAVTTSNYANWVQQKPGKS<br>PRGLIGGTNKRAPGVPARFSGSLLGKAALTISGAQPEDEADYYC<br>ALWYSNHWVFGGGTKLTVLEPKSSDKTHTCPPCPAPEFEGGPSV<br>FLFPPKPKDTLMISRTPEVTCVVVQVSHEDPEVKFNWYVDGVEVH<br>NAKTKPREEQYNSTYRVVSVLTVLHQDWLNGKEYKCKVSNKALPA<br>SIEKTISKAKGQPREPQVYTLPPCRKKLTKNQVSLTCLVKGFYPSDI<br>AVEWESNGQPENNYKTTPPVLKSDGSFFLYSKLTVDKSRWQQGN<br>VFSCSVMHEALHNHYTQKSLSLSPG | Muc17scfV-CD3scfv |
| 362 | QVQLVQSGAEVKKPGSSVKVSCKASGYTFTSYWMNWVRQAPGQ<br>GLEWMGMIHPSDSETRLNQKFKDRVTITADKSTSTAYMELSSLRS<br>EDTAVYYCARQGIITSVQEFAYWGQGTLVTVSSGGGGSGGGGSG<br>GGGSGGGGSIQMTQSPSSLSASVGDRVTITCSASSSVNYIYWYQ<br>QKPGKAPKLLIYRTSNLASGVPSRFSGSGSGTDFTITISSLQPEDF<br>ATYYCQQYHSYPLTFGGGTKVEIKSGGGSEVQLVESGGGLVQPG<br>GSLRLSCAASGFTFSTYAMNWVRQAPGKGLEWWGRIRSKINNYAT<br>YYADSVKGRFTISRDDSKNTLYLQMNSLRAEDTAVYYCVRHGNFG<br>DSYVSWFAYWGQGTLVTVSSGKPGSGKPGSGKPGSGKPGSQAV<br>VTQEPSLTVSPGGTVTLTCGSSTGAVTTSNYANWVQQKPGKSPR<br>GLIGGTNKRAPGVPARFSGSLLGKAALTISGAQPEDEADYYCAL<br>WYSNHWVFGGGTKLTVLEPKSSDKTHTCPPCPAPEFEGGPSVFL<br>FPPKPKDTLMISRTPEVTCVVVDVSHEDPEVKFNWYVDGVEVHNA<br>KTKPREEQYNSTYRVVSVLIVLHQDWLNGKEYKCKVSNKALPASI<br>EKTISKAKGQPREPQVYTLPPCRKKLTKNQVSLTCLVKGFYPSDIA<br>VEWESNGQPENNYKTTPPVLKSDGSFFLYSKLTVDKSRWQQGNV<br>FSCSVMHEALHNHYTQKSLSLSPGK | Muc17scfv-CD3scfv |
| 363 | QVQLVQSGAEVKKPGSSVKVSCKASGYTFTSYWMNWVRQAPGQ<br>GLEWMGMIHPSDSETRLNQKFKDRVTITADKSTSTAYMELSSLRS<br>EDTAVYYCARQGIITSVQEFAYWGQGTLVTVSSGGGGSGGGGSG<br>GGGSGGGGSIQMTQSPSSLSASVGDRVTITCSASSSVNYIYWYQ<br>QKPGKAPKLLIYRTSNLASGVPSRFSGSGSGTDFTLTISSLQPEDF<br>ATYYCQQYHSYPLTFGGGTKVEIKSGGGSEVQLVESGGGLVQPG<br>GSLRLSCAASGFTFSTYAMNWVRQAPGKGLEWVGRIRSKYNNYA<br>TYYADSVKGRFTISRDDSKNTLYLQMNSLRAEDTAVYYCVRHGNF<br>GDSYVSWFAYWGQGTLVTVSSGKPGSGKPGSGKPGSGKPGSQA<br>VVTQEPSLTVSPGGTVTLTCGSSTGAVTTSNYANWVQQKPGKSP<br>RGLIGGTNKRAPGVPARFSGSLLGKAALTISGAQPEDEADYYCA<br>LWYSNHWVFGGGTKLTVLEPKSSDKTHTCPPCPAPEFEGGPSVF<br>LFPPKPKDTLMISRTPEVTCVVVDVSHEDPEVKFNWYVDGVEVHN<br>AKTKPREEQYNSTYRVVSVLTVLHQDWLNGKEYKCKVSNKALPAS<br>IEKTISKAKGQPREPQVYTLPPCRKKLTKNQVSLTCLVKGFYPSDIA<br>VEWESNGQPENNYKTTPPVLKSDGSFFLYSKLTVDKSRWQQGNV<br>FSCSVMHEALHNHYTQKSLSLSPGK | Muc17scfv-CD3scfv |
| 364 | QVQLVQSGAEVKKPGSSVKVSCKASGYTFTSYWMNWVRQAPGQ<br>GLEWMGMIHPSDSETRLNQKFKDRVTITADKSTSTAYMELSSLRS<br>EDTAVYYCARQGIITSVQEFAYWGQGTLVTVSSGGGGSGGGGSG<br>GGGSGGGGSIQMTQSPSSLSASVGDRVTITCSASSSVNYIYWYQ<br>QKPGKAPKLLIYRTSNLASGVPSRFSGSGSGTDFTLTISSLQPEDF<br>ATYYCQQYHSYPLTFGGGTKVEIKSGGGSEVQLVESGGGLVQPG<br>GSLRLSCAASGFTFSTYAMNWVRQARGKGLEWYGRIRSKYNNYA<br>TYYADSVKGRFTISRDDSKNTLYLQMNSLRAEDTAVYYCVRHGNF<br>GDSYVSWFEYWGQGTLVTVSSGKPGSGKPGSGKPGSGKPGSQA<br>VVTQERSLTVSPGGTVTLTCGSSTGAVTTSNYANWVQQKPGKSP<br>RGLIGGTNKRAPGVPARFSGSLLGKAALTISGAQPEDEADYYCA<br>LWYSNHWVFGGGTKLTVLEPKSSDKTHTCPPCPAPEFEGGPSVF | Muc17scfv-CD3scfv |

TABLE 20-continued

SEQUENCES

| Seq ID | sequence | name |
|---|---|---|
| | LFPPKPKDTLMISRTPEVTCVVVDVSHEDPEVKFNWYVDGVEVAN AKTKPREEQYNSTYRVVSVLTVLHQDWLNGKEYKCKVSNKALPAS IEKTISKAKGQPREPQVYTLPPCRKKLTKNQVSLTCLVKGFYPSDIA VEWESNGQPENNYKTTPPVLKSDGSFFLYSKLTVDKSRWQQGNV FSCSVMHEALMNNYTQKSLSLSPGK | |
| 365 | QVQLVQSGAEVKKPGSSVKVSCKASGYTFTSYWMNWVRQAPGQ GLEWMGMIHPSDSETRLNQKFKDRVTITADKSTSTAYMELSSLRS EDTAVYYCARQGIITSVQEFNYWGQGTLVTVSSGGGGSGGGGSG GGGGGGGSIQMTQSPSSLSASVGDRVTITCSASSSVNYIYWYQ QKPGKAPKLLIYRTSNLASGVPSRFSGSGSGTDFTLTISSLQPEDF ATYYCQQYHSYPLTFGGGTKVEIKSGGGSEVQLVESGGGLVQPG GSLRISCAASGFTFSTYAMNWVRQAPGKGLEWVGRIRSKYNNYA TYYADSVKGRFTISRDDSKNTLYLQMNSLRAEDTAVYYCVRHGNF GDSYVSWFAYWGQGTLVTVSSGKPGSGKPGSGKPGSGKPGSQA VVTQEPSLTVSPGGTVTLTCGSSTGAVTTSNYANWVQQKPGKSP RGLIGGTNKRAPGVPARFSGSLLGGKAALTISGAQPEDEADYYCA LWYSNHWVFGGGTKLTVLEPKSSDKTHTCPPCPAPEFEGGPSVF LFPPKPKDTLMISRTPEVTCVVVDVSHEDPEVKFNWYVDGVEVHN AKTKPREEQYNSTYRVVSVLTVLHQDWLNGKEYKCKVSNKALPAS IEKTISKAKGQPREPQVYTLPPCRKKLTKNQVSLTCLVKGFYPSDIA VEWESNGQPENNYKTTPPVLKSDGSFFLYSKLTVDKSRWQQGNV FSCSVMHEALHNHYTQKSLSLSPGK | Muc17scfv-CD3scfv |
| 366 | EVQLVQSGAEVKKPGESLKISCKGSGYEFSSHWMNWVRQMPGK GLEWMGQIYPGQGDINYNEKFRGQVTISADKSISTAYLQWSSLKA SDTAMYYCARHGNYVMDYWGQGTLVTVSSGKPGSGKPGSGKPG SGKPGSIQLTQSPSFLSASVGDRVTITCSASSSVSYMFWYQQKPG KAPKPWIYRTSNLASGVPSRFSGSGSGTEFTLTISSLQPEDFATYY CQQFHDYPRTFGGGTKVEIKEPKSSDKTHTCPPCPAPEFEGGPSV FLFPPKPKDTLMISRTPEVTCVVVDVSHEDPEVKFNWYVDGVEVH NAKTKPREEQYNSTYRVVSVLTVLHQDWLNGKEYKCKVSNKALPA SIEKTISKAKGQPREPQVYTLPPCRKKLTKNQVSLTCLVKGFYPSDI AVEWESNGQPENNYKTTPPVLKSDGSFFLYSKLTVDKSRWQQGN VFSCSVMHEALHNHYTQKSLSLSPGK | Muc17scfv-Fc |
| 367 | QVQLVQSGAEVKKPGSSVKVSCKASGYTFTSYWMNWVRQAPGQ GLEWMGMIHPSDSETRLNQKFKDRVTITADKSTSTAYMELSSLRS EDTAVYYCARQGIITSVQEFAYWGQGTLVTVSSGKPGSGKPGSGK PGSGKPGSIQMTQSPSSLSASVGDRVTITCSASSSVNYIYWYQQK PGKAPKLLIYRTSNLASGVPSRFSGSGSGTDFTLTISSLQPEDFATY YCQQYHSYPLTFGGGTKVEIKEPKSSDKTHTCPPCPAPEFEGGPS VFLFPPKPKDTLMISRTPEVTCVVVDVSHEDPEVKFNWYVDGVEV HNAKTKPREEQYNSTYRVVSVLTVLHQDWLNGKEYKCKVSNKAL PASIEKTISKAKGQPREPQVYTLPPCRKKLTKNQVSLTCLVKGFYP SDIAVEWESNGQPENNYKTTPPVLKSDGSFFLYSKLTVDKSRWQQ GNVFSCSVMHEALHNHYTQKSLSLSPGK | Muc17scfv-Fc |
| 368 | EVQLVESGGGLVQPGGSLRLSCAASGFTFSSFGMHWWRQARGK GLEWVSYISSGSSTIYYADTVKGRFTISRDNAKNSLYLQMNSLRAE DTAVYYCARWGYYGSSYFAYWGQGTLVTVSSASTKGPSVFPLAP SSKSTSGGTAALGCLVKDYFPEPVTVSWNSGALTSGVHTFPAVLQ SSGLYSLSSVVTVPSSSLGTQTYICNVNHKPSNTKVDKRVEPKSG DKTHTCPPCPAPEFEGGPSVFLFPPKPKDTLMISRTPEVTCVVVDV SHEDPEVKFNWYVDGVEVHNAKTKPREEQYNSTYRVVSVLTVLH QDWLNGKEYKCKVSNKALPASIEKTISKAKGQPREPQVCTLPPSR DELTKNQVSLTCLVEGFYPSDIAVEWESNGQPENNYKTTPPVLDS DGSFFLYSDLTVDKSRWQQGNVFSCSVMHEALHNHYTQESLSLS PGK | HC; Muc17.7, Muc17.21, Muc17.22, Muc17.23, Muc17.24 |
| 369 | EVQLVQSGAEVKKPGESLKISCKGSGYEFSSHWMNWVRQMPGK GLEWMGQIYPGDGDINYNEKFRGQVTISADKSISTAYLQWSSLKA SDTAMYYCARHGNYVMDYWGQGTLVTVSSASTKGPSVFPLAPSS KSTSGGTAALGCLVKDYFPEPVTVSWNSGALTSGVHTFPAVLQSS GLYSLSSVVTVPSSSLGTQTYICNVNHKPSNTKVDKRVEPKSCDKT HTCPPCPAPEFEGGPSVFLFPPKPKDTLMISRTPEVTCVVVDVSHE DPEVKFNWYVDGVEVHNAKTKPREEQYNSTYRVVSVLTVLHQDW LNGKEYKCKVSNKALPASIEKTISKAKGQPREPQVCTLPPSRDELT KNQVSLTCLVEGFYPSDIAVEWESNGQPENNYKTTPPVLQSDGSF FLYSDLTVDKSRWQQGNVFSCSVMHEALHNHYTQESLSLSPGK | HC; Muc17.1, Muc17.8, Muc17.9. Muc17.10, Muc17.11, Muc17.12, Muc17.13, Muc17.14 |
| 370 | QVQLVQSGAEVKKPGASVKVSCKASGYEFSSHWMNWVRQAPGQ GLEWMGQIYPGDGDINYNEKFRGRVTMTRDTSTSTVYMELSSLRS EDTAVYYCARHGNYVMDYWGQGTLVTVSSASTKGPSVFPLAPSS KSTSGGTAALGCLVKDYFPEPVTVSWNSGALTSGVHTFPAVLQSS GLYSLSSVVTVPSSSLGTQTYICNVNHKPSNTKVDKRVEPKSCDKT | HC; Muc17.29, Muc17.30, Muc17.31 |

TABLE 20-continued

| Seq ID | sequence | name |
|---|---|---|
| | HTCPPCPAPEFEGGPSVFLFPPKPKDTLMISRTPEVTCVVVDVSHE<br>DREVKFNWYVDGVEVHNAKTKPREEQYNSTYRVVSVLTVLHQDW<br>LNGKEYKCKVSNKALPASIEKTISKAKGQPREPQVCTLPPSRDELT<br>KNQVSLTCLVEGFYPSDIAVEWESNGQPENNYKTTPPVLDSDGSF<br>FLYSDLTVDKSRWQQGNVFSCSVMHEALHNHYTQESLSLSPGK | |
| 371 | QVQLVQSGAEVKKPGASVKVSCKASGYTFTSYWMNWVRQAPGQ<br>GLEWIGMIHPSDSETRLNQKFKDRVILTVQKSSSTAYMELSSLRSE<br>DTAVYYCARQGIITSVQEFAYWGQGTLVTVSSASTKGPSVFPLAPS<br>SKSTSGGTAALGCLVKDYFPEPVTVSWNSGALTSGVHTFPAVLQS<br>SGLYSLSSVVTVPSSSLGTQTYICNVNHKPSNTKVQKRVEPKSCD<br>KTHTCPPCPAPEFEGGPSVFLFPPKPKDTLMISRTPEVTCVVVDVS<br>HEDPEVKFNWYVDGVEVHNAKTKPREEQYNSTYRVVSVLTVLHQ<br>DWLNGKEYKCKVSNKALPASIEKTISKAKGQPREPQVCTLPPSRD<br>ELTKNQVSLTCLVEGFYPSDIAVEWESNGQPENNYKTTPPVLDSD<br>GSFFLYSDLTVDKSRWQQGNVFSCSVMHEALHNHYTQESLSLSP<br>GK | HC;<br>Muc17.45 |
| 372 | QVQLVQSGAEVKKPGASVKVSCKASGYTFTSYWMNWVRQAPGQ<br>GLEWMGMIHPSDSETRLNQEFKDRVTMTRDTSTSTVYMELSSLR<br>SEDTAVYYCARQGVITSVQEFAYWGQGTLVTVSSASTKGPSVFPL<br>APSSKSTSGGTAALGCLVKDYFPEPVTVSWNSGALTSGVHTFPAV<br>LQSSGLYSLSSVVTVPSSSLGTQTYICNVNHKPSNTKVDKRVEPKS<br>CDKTHTCPPCPAPEFEGGPSVFLFPPKPKDTLMISRTPEVTCVVVD<br>VSHEDPEVKPNWYVDGVEVHNAKTKPREEQYNSTYRVVSVLTVL<br>HQDWLNGKEYKCKVSNKALPASIEKTISKAKGQPREPQVCTLPPS<br>RDELTKNQVSLTCLVEGFYPSDIAVEWESNGQPENNYKTTPPVLD<br>SDGSFFLYSDLTVDKSRWQQGNVFSCSVMHEALHNHYTQESLSL<br>SPGK | HC;<br>Muc17.5,<br>Muc17.20 |
| 373 | QVQLVQSGAEVKKPGASVKVSCKASGYTFTSYWMNWVRQAPGQ<br>GLEWMGMIHPSDSETRLNQKFKDRVTLTRDKSISTAYMELSRLRS<br>DDTAVYYCARQGIITSVQEFAYWGQGTLVTVSSASTKGPSVFPLA<br>PSSKSTSGGTAALGCLVKDYFPEPVTVSWNSGALTSGVHTFPAVL<br>QSSGLYSLSSVVTVPSSSLGTQTYICNVNHKPSNTKVDKRVEPKS<br>CDKTHTCPPCPAPEREGGPSVFLAPPKPKDTLMISRTPEVTCVVVD<br>VSHEDPEVKFNWYVDGVEVHNAKTKPREEQYNSTYRVVSVLTVL<br>HQDWLNGKEYKCKVSNKALPASIEKTISKAKGQPREPQVCTLPPS<br>RDELTKNQVSLTCLVEGFYPSDIAVEWESNGQPENNYKTTPPVLD<br>SDGSFFLYSDLTVDKSRWQQGNVFSCSVMHEALHNHYTQESLSL<br>SPGK | HC;<br>Muc17.37 |
| 374 | QVQLVQSGAEVKKPGASVKVSCKASGYTFTSYWMNWVRQAPGQ<br>GLEWMGMIHPSDSETRLNQKFKDRVTLTVDKSISTAYMELSRLRS<br>DDTAVYYCARQGIITSVQEFAYWGQGTLVTVSSASTKGPSVFPLA<br>PSSKSTSGGTAALGCLVKDYFPEPVTVSWNSGALTSGVHTFPAVL<br>QSSGLYSLSSVVTVPSSSLGTQTYICNVNHKPSNTKVDKRVEPKS<br>CDKTHTCPPCPAPEFEGGPSVFLFPPKPKDTLMISRTPEVTCVVVD<br>VSHEDPEVKFNWYVDGVEVHNAKTKPREEQYNSTYRVVSVLTVL<br>HQDWLNGKEYKCKVSNKALPASIEKTISKAKGQPREPQVCTLPPS<br>RDELTKNQVSLTCLVEGFYPSDIAVEWESNGQPENNYKTTPPVLD<br>SDGSFFLYSDLTVDKSRWQQGNVFSCSVMMEALMNHYTQESLSL<br>SPGK | HC;<br>Muc17.35 |
| 375 | QVQLVQSGAEVKKPGASVKVSCKASGYTFTSYWMNWVRQAPGQ<br>GLEWMGMIHPSDSETRLNGKPKDRVTLTVDTSISTAYMELSRLRS<br>DDTAVYYCARQGIITSVQEFAYWGQGTLVTVSSASTKGPSVFPLA<br>PSSKSTSGGTAALGCLVKDYFPEPVTVSWNSGALTSGVHTFPAVL<br>QSSGLYSLSSVVTVPSSSLGTQTYICNVNHKPSNTKVDKRVEPKS<br>CDKTHTCPPCPAPEFEGGPSVFLFPPKPKDTLMISRTPEVTCVVVD<br>VSHEDPEVKFNWYVDGVEVHNAKTKPREEQYNSTYRVVSVLTVL<br>HQDWLNGKEYKCKVSNKALPASIEKTISKAKGQPREPQVCTLPPS<br>RDELTKNQVSLTCLVEGFYPSDIAVEWESNGQPENNYKTTPPVLD<br>SDGSFFLYSDLTVDKSRWQQGNVFSCSVMHEALHNHYTQESLSL<br>SPGK | HC;<br>Muc17.36 |
| 376 | QVQLVQSGAEVKKPGASVKVSCKASGYTFTSYWMNWVRQAPGQ<br>GLEWMGMIHPSDSETRLNQKFKDRVTMTRDTSISTAYMELSRLRS<br>DDTAVYYCARQGIITSVQEFAYWGQGTLVTVSSASTKGPSVFPLA<br>PSSKSTSGGTAALGCLVKDYFPEPVTVSWNSGALTSGVHTFPAVL<br>QSSGLYSLSSVVTVPSSSLGTQTYICNVNHKPSNTKVDKRVEPKS<br>CDKTHTCPPCPAPEFEGGPSVFLFPPKPKDTLMISRTPEVTCVVVD<br>VSHEDPEVKFNWYVDGVEVHNAKTKPREEQYNSTYRVVSVLTVL<br>HQDWLNGKEYKCKVSNKALPASIEKTISKAKGQPREPQVCTLPPS | HC;<br>Muc17.232,<br>Muc17.33,<br>Muc17.34 |

TABLE 20-continued

| Seq ID | sequence | name |
|---|---|---|
| | RDELTKNQVSLTCLVEGFYPSDIAVEWESNGQPENNYKTTPPVLD SDGSFFLYSDLTVDKSRWQQGNVFSCSVMHEALHNHYTQESLSL SPGK | |
| 377 | QVQLVQSGAEVKKPGASVKVSCKASGYTFTSYWMNWVRQAPGQ GLEWMGMIHPSDSETRLNQKFKDRVTMTRDTSTSTVYMELSSLR SEDTAVYYCARQGIITSVQEFAYWGQGTLVTVSSASTKGPSVFPLA PSSKSTSGGTAALGCLVKDYFREPVTVSWNSGALTSGVHTFPAVL QSSGLYSLSSVVTVPSSSLGTQTYICNVNHKPSNTKVDKRVEPKS CDKTHTCPPCPAPEPEGGPSVFLFPPKPKDTLMISRTPEVTCVVVD VSHEDPEVKFNWYVDGVEVHNAKTKPREEQYNSTYRVVSVLTVL HQDWLNGKEYKCKVSNKALPASIEKTISKAKGQPREPQVCTLPPS RDELTKNQVSLTCLVEGFYPSDIAVEWESNGQPENNYKTTPPVLD SDGSFFLYSDLTVDKSRWQQGNVFSCSVMHEALHNHYTQESLSL SPGK | HC: Muc17.31, Muc17.48, Muc17.49 |
| 378 | QVQLVQSGAEVKKPGASVKVSCKASGYTFTSYWMNWVRQAPGQ GLEWMGMIHPSDSETRLNQKFKDRVTMTVDKSISTAYMELSRLRS DDTAVYYCARQGIITSVQEFAYWGQGTLVTVSSASTKGPSVFPLA PSSKSTSGGTAALGCLVKDYFPEPVTVSWNSGALTSGVHTFPAVL QSSGLYSLSSVVTVPSSSLGTQTYICNVNHKPSNTKVDKRVEPKS CDKTHTCPPCPAPEFEGGPSVFLFPPKPKDTLMISRTPEVTCVVVD VSHEDPEVKFNWYVDGVEVNNAKTKPREEQYNSTYRVVSVLTVL HQDWLNGKEYKCKVSNKALPASIEKTISKAKGQPREPQVCTLPPS RDELTKNQVSLTCLVEGFYPSDIAVEWESNGQPENNYKTTPPVLD SDGSFFLYSDLTVDKSRWQQGNVFSCSVMHEALHNHYTQESLSL SPGK | HC; Muc17.38 |
| 379 | QVQLVQSGAEVKKPGSSVKVSCKASGYEFSSHWMNWVRQAPGQ GLEWMGQIYPGDGDINYNEKFRGRVTITADKSTSTAYMELSSLRS EDTAVYYCARHGNYVMDYWGQGTTVTVSSASTKGPSVFPLAPSS KSTSGGTAALGCLVKDYFPEPVTVSWNSGALTSGVHTFPAVLQSS GLYSLSSVVTVPSSSLGTQTYICNVNHKPSNTKVDKRVEPKSCDKT HTCPPCPAPEFEGGPSVFLFPPKPKDTLMISRTPEVTCVVVDVSHE DPEVKFNWYVDGVEVHNAKTKPREEQYNSTYRVVSVLTVLNQDW LNGKEYKCKVSNKALPASIEKTISKAKGQPREPQVCTLPPSRDELT KNQVSLTCLVEGFYPSDIAVEWESNGQPENNYKTTPPVLDSDGSF FLYSDLTVDKSRWQQGNVFSCSVMHEALHNHYTQESLSLSPGK | HC; Muc17.25, Muc17.26, Muc17.27, Muc17,28 |
| 380 | QVQLVQSGAEVKKPGSSVKVSCKASGYTFTSYWMNWVRQAPGQ GLEWMGMIHPSDSETRLNQKFKDRVTITADKSTSTAYMELSSLRS EDTAVYYCARQGIITSVQEFAYWGQGTLVTVSSASTKGPSVFPLAP SSKSTSGGTAALGCLVKDYFPEPVTVSWNSGALTSGVHTFPAVLQ SSGLYSLSSVVTVPSSSLGTQTYICNVNHKPSNTKVDKRVEPKSC DKTHTCPPCPAPEFEGGPSVFLAPPKPKDTLMISRTPEVTCVVVDV SHEDPEVKFNWYVDGVEVHNAKTKPREEQYNSTYRVVSVLTVLH QDWLNGKEYKCKVSNKALPASIEKTISKAKGQPREPQVCTLPPSR DELTKNQVSLTCLVEGFYPSDIAVEWESNGQPENNYKTTPPVLDS DGSFFLYSDLTVDKSRWQQGNVFSCSVMHEALHNHYTQESLSLS PGK | HC; Muc17.4, Muc17.15, Muc17.16, Muc17.18, Muc17.19 |
| 381 | DIQMTQSPSSLSASVGDRVTITCKASEDIYNRLAWYQQKPGKAPKL LIYGATNLETGVPSRFSGSGSGKDYTLTISSLQPEDIATYYCQQFW RTPPTFGGGTKVEIKRTVAAPSVFIFPPSDEQLKSGTASVVCLLNN FYPREAKVQWKVDNALQSGNSQESVTEQDSKDSTYSLSSTLTLSK ADYEKHKVYACEVTHQGLSSPVTKSFNRGEC | LC; Muc17,23 |
| 382 | DIQMTQSPSSLSASVGDRVTITCKASEDIYNRLAWYQQKPGKAPKL LIYGATNLETGVPSRFSGSGSGTDFTFTISSLQPEDIATYYCQQFW RTPPTFGGGTKVEIKRTVAAPSVFIFPPSDEQLKSGTASVVCLLNN FYPREAKVQWKVDNALQSGNSQESVTEQDSKDSTYSLSSTLTLSK ADYEKHKVYACEVTHQGLSSPVTKSFNRGEC | LC; Muc17.24 |
| 383 | DIQMTQSPSSLSASVGDRVTITCKASEDIYNRLAWYQQKPGKAPK PLISGATNLETGVPSRFSGSGSGKDYTLTISSLQPEDIATYYCQQF WRTPPTFGGGTKVEIKRTVAAPSVFIFPPSDEQLKSGTASVVCLLN NFYPREAKVQWKVDNALQSGNSQESVTEQDSKDSTYSLSSTLTLS KADYEKHKVYACEVTHQGLSSPVTKSENRGEC | LC; Muc17.21 |
| 384 | DIQMTQSPSSLSASVGDRVTITCKASEDIYNRLAWYQQKPGKAPK PLISGATNLETGVPSRFSGSGSGTDFTFTISSLQPEDIATYYCQQF WRTPPTFGGGTKVEIKRTVAAPSVFIFPPSDEQLKSGTASVVCLLN NFYPREAKVQWKVDNALQSGNSQESVTEQDSKDSTYSLSSTLTLS KADYEKHKVYACEVTHQGLSSPVTKSENRGEC | LC; Muc17.7 |

TABLE 20-continued

SEQUENCES

| Seq ID | sequence | name |
|---|---|---|
| 385 | DIQMTQSPSSLSASVGDRVTITCKASEDIYNRLAWYQQKPGKAPK PLIYGATNLETGVPSRFSGSGSGTDFTFTISSLQPEDIATYYCQQF WRTPPTFGGGTKVEIKRTVAARSVFIFRPSDEQLKSGTASVVCLLN NFYPREAKVQWKVDNALQSGNSQESVTEQDSKDSTYSLSSTLTLS KADYEKHKVYACEVTHQGLSSPVTKSFNRGEC | LC; Muc17.22 |
| 386 | EIVLTQSPATLSLSPGERATLSCSASSSVNYIYWYQQKPGQAPRLLI YRTSNLASGIPARFSGSGSGTDFTLTISSLEPEDFAVYYCQQYHSY PLTFGGGTKVEIKRTVAAPSVFIFPPSDEQLKSGTASVVCLLNNFYP REAKVQWKVDNALQSGNSQESVTEQDSKDSTYSLSSTLTLSKAD YEKHKVYACEVTHQGLSSPVTKSFNRGEC | LC; Muc17.16, Muc17.17, Muc17.34, Muc17.39, Muc17.42, Muc17.49 |
| 387 | EIVLTQSPATLSLSPGERATLSCSASSSVSYMFWYQQKPGQAPRL LIYRTSNLASGIRARFSGSGSGTDFTLTISSLEPEDFAVYYCQQFHD YPRTFGGGTKVEIKRTVAAPSVFIFPPSDEQLKSGTASVVCLLNNF YPREAKVQWKVDNALQSGNSQESVTEQDSKDSTYSLSSTLTLSKA DYEKHKVYACEVTHQGLSSPVTKSFNRGEG | LC; Muc17.8. Muc17.27, Muc17.31 |
| 388 | EIVLTQSPATLSLSPGERATLSCSASSSVSYMFWYQQKPGQAPRP WIYRTSNLASGIPPRFSGSGSGTDYTLTISSLEPEDFAVYYCQQFH DYPRTFGGGTKVEIKRTVAAPSVFIFPPSDEQLKSGTASVVCLLNN FYPREAKVQWKVQNALQSGNSQESVTEQDSKDSTYSLSSTLILSK ADYEKHKVYACEVTHQGLSSPVIKSFNRGEC | LC; Muc17.28 |
| 389 | EIVLTQSPATLSVSPGERATLSCSASSSVNYIYWYQQKPGQAPRP WYRTSNLASGIPARFSGSGSGTEYTLTISSLQSEDFAVYYCQQYH SYPLTFGGGTKVEIKRTVAAPSVFIFPPSDEQLKSGTASVVGLLNNF YPREAKVQWKVDNALQSGNSQESVTEQDSKDSTYSLSSTLTLSKA DYEKHKVYACEVTHQGLSSPVTKSFNRGEC | LC; Muc17.20 |
| 390 | EIVMTQSPATLSVSPGERATLSCSASSSVNYIYWYQQKPGQAPRL LIYRTSNLASGIPARFSGSGSGTEFTLTISSLQSEDFAVYYCQQYHS YPLTFGGGTKVEIKRTVAAPSVFIFPPSDEQLKSGTASVVCLLNNFY PREAKVQWKVQNALQSGNSQESVTEQDSKDSTYSLSSTLTLSKA DYEKHKVYACEVTHQGLSSVTKSFNRGEC | LC; Muc17.5, Muc17.15, Muc17.33, Muc17.45, Muc17.48 |
| 391 | EIVMTQSPATLSVSPGERATLSCSASSSVSYMFWYQQKPGQAPRL LIYRTSNLASGIPARFSGSGSGTEFTLTISSLQSEDFAVYYCQQFHD YPRTFGGGTKVEIKRTVAAPSVFIFPPSDEQLKSGTASVVCLLNNF YPREAKVQWKVDNALQSGNSQESVTEQDSKDSTYSLSSTLTLSKA DYEKNKVYACEVTHQGLSSPVTKSENRGEC | LC; Muc17.14, Muc17.26, Muc17.30 |
| 392 | IQLTQSPSFLSASVGDRVTITCSASSSVSYMFWYQQKPGKAPKLLI YRTSNLASGVPPRFSGSGSGTEFTLTISSLQPEDFATYYCQQFHD YPRTFGGGTKVEIKRTVAAPSVFIFPPSDEQLKSGTASVVQLLNNF YPREAKVQWKVDNALQSGNSQESVTEQDSKDSTYSLSSTLTLSKA DYEKHKVYACEVTHQGLSSPVTKSFNRGEC | LC; Muc17.13 |
| 393 | IQLTQSPSFLSASVGDRVTITCSASSSVSYMFWYQQKPGKAPKLLI YRTSNLASGVPPRFSGSGSGTEYTLTISSLQPEDFATYYCQQFHD YPRTFGGGTKVEIKRTVAAPSVFIFPPSDEQLKSGTASVVCLLNNA YPREAKVQWKVDNALQSGNSQESVTEQDSKDSTYSLSSTLTLSKA DYEKHKVYACEVTHQGLSSPVTKSFNRGEC | LC; Muc17.11 |
| 394 | IQLTQSPSFLSASVGDRVTITCSASSSVSYMFWYQQKPGKAPKLLI YRTSNLASGVPSRFSGSGSGTEFTLTISSLQPEDFATYYCQQFHD YPRTFGGGTKVEIKRTVAARSVFIFPPSDEQLKSGTASVVQLLNNF YPREAKVQWKVDNALQSGNSQESVTEQDSKDSTYSLSSTLTLSKA DYEKHKVYACEVTHQGLSSPVTKSFNRGEC | LC: Muc17.9, Muc17.25. Muc17.29 |
| 396 | IQLTQSPSFLSASVGDRVTITCSASSSVSYMFWYQQKPGKAPKLLI YRTSNLASGVPSRFSGSGSGTEYTLTISSLQPEDFATYYCQQFHD YPRTFGGGTKVEIKRTVAAPSVFIFPPSDEQLKSGTASVVQLLNNF YPREAKVQWKVDNALQSGNSQESVTEQDSKDSTYSLSSTLTLSKA DYEKHKVYACEVTHQGLSSPVTKSFNRGEC | LC: Muc17.10 |
| 397 | IQLTQSPSFLSASVGDRVTITCSASSSVSYMFWYQQKPGKAPKPW IYRTSNLASGVPPRFSGSGSGTEYTLTISSLQPEDFATYYCQQPHD YPRTFGGGTKVEIKRTVAAPSVFIFPPSDEQLKSGTASVVCLLNNF YPREAKVQWKVDNALQSGNSQESVTEQDSKDSTYSLSSTLTLSKA DYEKHKVYACEVTHQGLSSPVTKSFNRGEC | LC; Muc17.12 |

TABLE 20-continued

| SEQUENCES | | |
|---|---|---|
| Seq ID | sequence | name |
| 398 | IQLTQSPSFLSASVGDRVTITCSASSSVSYMFWYQQKPGKAPKPWV IYRTSNLASGVPSRFSGSGSGTEFTLTISSLQPEDFATYYCQQFHD YPRTFGGGTKVEIKRTVAAPSVFIFPPSDEQLKSGTASVVQLLNNF YPREAKVQWKVQNALQSGNSQESVTEQDSKDSTYSLSSTLTLSKA DYEKHKVYACEVTHQGLSSPVTKSFNRGEC | LC: Muc17.1 |
| 399 | IQMTQSPSSLSASVGDRVTITCSASSSVNYIYWYQQKPGKAPKLLI YRTSNLASGVPSRFSGSGSGTDATLTISSLQPEDFATYYCQQYHS YPLTFGGGTKVEIKRTVAAPSVFIFPPSDEQLKSGTÅSVVQLLNNFY PREAKVQWKVDNALQSGNSQESVTEQDSKDSTYSLSSTLTLSKA DYEKHKVYACEVTHQGLSSPVTKSFNRGEC | LC; Muc17.4, Muc17.31, Muc17.32, Muc17.35, Muc17.36, Muc17,387, Muc17.38, Muc17.40, Muc17.43, Muc17.47 |
| 400 | QAVVTQEPSLTVSPGGTVTLTCGSSTGAVTTSNYANWVQQKPGK SPRGLIGGTNKRAPGVPARFSGSLLGGKAALTISGAQPEDEADYY CALWYSNHWVFGGGTKLTVLRTVAAPSVFIFPPSDEQLKSGTASV VCLLNNFYPREAKVQWKVDNALQSGNSQESVTEQDSKDSTYSLS STLTLSKADYEKHKVYACEVTHQGLSSPVTKSENRGEC | LC; CD3 |
| 401 | EVQLVESGGGLVQPGGSLRLSCAASGFTFSSFGMHWVRQAPGK GLEWVAYISSGNSAIYYADTVNGRFTISRDNPKNTLYLQMNSLRAE DTAVYYCARLRYGNSFDYWGQGTLVTVSSASTKGPSVFPLAPSSK STSGGTAALGCLVKDYFPEPVTVSWNSGALTSGVHTFPAVLQSSG LYSLSSVVTVPSSSLGTQTYICNVNHKPSNTKVDKRVEPKSCDKTH TCPPCPAPEFEGGPSVELFPPPKPKDTLMISRTPEVTCVVVDVSHED PEVKPNWYVDGVEVHNAKTKPREEQYNSTYRVVSVLTVLHQDWL NGKEYKCKVSNKALPASIEKTISKAKGQPREPQVCTLPPSRDELTK NQVSLTCLVEGFYPSDIAVEWESNGQPENNYKTTPPVLQSDGSFF LYSDLTVDKSRWQQGNVFSCSVMHEALHNHYTQESLSLSPGK | HC; CLDN182.12 CLND182.13 |
| 402 | EVQLVESGGGLVQPGGSLRLSCAASGFTFSSFGMHWVRQAPGK GLEWVSYISSGNSAIYYADTVNGRFTISRDNAKNSLYLQMNSLRAE DTAVYYCARLRYGNSFDYWGQGTLVTVSSASTKGPSVFPLAPSSK STSGGTAALGCLVKDYFPEPVTVSWNSGALTSGVHTFPAVLQSSG LYSLSSVVTVPSSSLGTQTYICNVNHKPSNTKVDKRVEPKSCDKTH TCPPCPAPEFEGGPSVFLFPPPKPKDTLMISRTPEVTCVVVDVSHED PEVKFNWYVDGVEVHNAKTKPREEQYNSTYRVVSVLTVLHQDWL NGKEYKCKVSNKALPASIEKTISKAKGQPREPQVCTLPPSRDELTK NQVSLTCLVEGFYPSDIAVEWESNGQPENNYKTTPPVLDSDGSFF LYSDLTVDKSRWQQGNVFSCSVMHEALHNHYTQESLSLSPGK | HC CLDN182.3, CLDN182.7 |
| 403 | QIQLVQSGAEVKKPGASVKVSCKASGYTFTNSGMNWVRQAPGQ GLEWMGWINTNTGEPTFAEEFRGRVTFTLQTSASTAYMELSRLRS DDTAVYYCARYYYGNSFAYWGQGTLVTVSSASTKGPSVFPLAPS SKSTSGGTAALGCLVKDYPPEPVTVSWNSGALTSGVHTFPAVLQS SGLYSLSSVVTVPSSSLGTQTYIGNVNHKPSNTKVDKRVEPKSCD KTHTCPPCPAPEFEGGPSVFLFPPKPKDTLMISRTPEVTCVVVDVS HEDPEVKFNWYVDGVEVHNAKTKPREEQYNSTYRVVSVLTVLHQ DWLNGKEYKCKVSNKALPASIEKTISKAKGQPREPQVCTLPPSRD ELTKNQVSLTCLVEGFYPSDIAVEWESNGQPENNYKTTPPVLDSD GSFFLYSDLTVDKSRWQQGNVFSCSVMHEALHNHYTQESLSLSP SK | HC; CLDN182.14 |
| 404 | QVQLVQSGAEVKKPGASVKVSCKASGYTFTNFGITWVRQAPGQG LEWIGETYPSSGNTFYNEKFKGRVTLTADKSSSAAYMELRSLRSCD TAVYYCARGGGPLRSRYFDYWGQGTLVTVSSASTKGRSVFPLAP SSKSTSGGTAALGCLVKDYPPEPVTVSWNSGALTSGVHTFPAVLQ SSGLYSLSSVVTVPSSSLGTQTYICNVNHKPSNTKVDKRVEPKSC DKTHTCPPCPAPEFEGGPSVFLFPPKPKDTLMISRTPEVTCVVVDV SHEDPEVKFNWYVDGVEVHNAKTKPREEQYNSTYRVVSVLTVLH QDWLNGKEYKCKVSNKALPASIEKTISKAKGQPREPQVCTLPPSR DELTKNQVSLTCLVEGFYPSDIAVEWESNGQPENNYKTTPPVLDS DGSFFLYSDLTVDKSRWQQGNVFSCSVMHEALHNHYTQESLSLS PGK | HC; CLDN182.10, CLND182.11 |
| 405 | QVQLVQSGAEVKKPGASVKVSCKASGYTFTNFGITWVRQAPGQG LEWMGEIYPSSQNTFYNEKFKGRVTMTTDTSTAYMELRSLRSD DTAVYYCARGGGPLRSRYFDYWGQGTLVTVSSASTKGPSVEPLA PSSKSTSGGTAALGCLVKDYPPEPVTVSWNSGALTSGVHTFPAVL QSSGLYSLSSVVTVPSSSLGTQTYICNVNHKPSNTKVDKRVEPKS CDKTHTCPPCPAPEFEGGPSVFLFPPKPKDTLMISRTPEVTCVVVD | HC; CLDN182.4, CLND182.8 |

TABLE 20-continued

SEQUENCES

| Seq ID | sequence | name |
|---|---|---|
|  | VSHEDPEVKPNWYVDGVEVHNAKTKPREFQYNSTYRVVSVLTVL HQDWLNGKEYKCKVSNKALPASIEKTISKAKGQPREPQVCTLPPS RDELTKNQVSLTCLVEGFYPSDIAVEWESNGQPENNYKTTPPVLD SDGSFFLYSDLTVDKSRWQQGNVFSCSVMHEALHNHYTQESLSL SPGK |  |
| 406 | QVQLVQSGAFVKKPGASVKVSCKASGYTFTNSGMNWVRQAPGQ GLEWMGWINTNTGERTFAEEFRGRVTMTRDTSISTAYMELSRLRS DDTAVYYCARYYYGNSFAYWGQGTLVTVSSASTKGPSVFPLAPS SKSTSGGTAALGCLVKDYFPERVTVSWNSGALTSGVHTFPAVLQS SGLYSLSSVVTVPSSSLGTQTYICNVNHKPSNTKVDKRVEPKSCD KTHTCPPCPAPEFEGGPSVFLFPPKPKDTLMISRTPEVTCVVVDVS HEDPEVKFNWYVDGVEVHNAKTKPREEQYNSTYRVVSVLTVLHQ DWLNGKEYKCKVSNKALPASIEKTISKAKGQPREPQVCTLPPSRD ELTKNQVSLTCLVEGFYPSDIAVEWESNGQPENNYKTTPPVLDSD CSFFLYSDLTVDKSRWQQGNVFSCSVMHEALHNHYTQESLSLSP GK | HC; CLND182.2, CLND182.17 |
| 407 | QVQLVQSGAFVKKPGASVKVSCKASGYTFTNYGMNWVRQAPGQ GLEWMGWINTNTGEPTYAEEFKGRVTMTRDTSISTAYMELSRLRS DDTAVYYCARYFYGNSFVYWGQGTLVTVSSASTKGPSVFPLAPSS KSTSGGTAALGCLVKDYFPEPVTVSWNSGALTSGVHTFPAVLQSS GLYSLSSVVTVPSSSIGTQTYICNVNHKPSNTKVDKRVEPKSCDKT HTCPPCPAPEFEGGPSVFLFPPKPKDTLMISRTPEVTCVVVDVSHE DPEVKFNWYVDGVEVHNAKTKPREEQYNSTYRVVSVLTVLHQDW LNGKEYKCKVSNKALPASIEKTISKAKGQPREPQVCTLPPSRDELT KNQVSLTCLVEGFYPSDIAVEWESNGQPENNYKTTPPVLDSDGSF FLYSDLIVQKSRWQQGNVFSCSVMHEALHNHYTQESLSLSPGK | HC; CLDN182.1 |
| 408 | QVQLVQSGAEVKKPGSSVKVSCKASGYAFNNYWMNWVRQAPGQ GLEWMGQISPGNGNSNFNGKFKGRVTITADKSTSTAYMELSSLRS EDTAVYYCARGGRYGNAMDYWGQGTTVTVSSASTKGPSVFPLAP SSKSTSGGTAALGCLVKDYFPEPVTVSWNSGALTSGVHTFPAVLQ SSGLYSLSSVVTVPSSSLGTQTYICNVNHKPSNTKVDKRVEPKSC DKTHTCPPCPAPEFEGGPSVFLFPPKPKDTLMISRTPEVTCVVVDV SHEDPEVKFNWYVDGVEVHNAKTKPREEQYNSTYRVVSVLTVLH QDWLNGKEYKCKVSNKALPASIEKTISKAKGQPREPQVCTLPPSR DELTKNQVSLTCLVEGFYPSDIAVEWESNGQPENNYKTTPPVLDS DGSFFLYSDLTVDKSRWQQGNVFSCSVMHEALHNHYTQESLSLS PGK | HC; CLND182.5 |
| 409 | QVQLVQSGAEVKKPGSSVKVSCKASGYAFSSYWMNWVRQAPGQ GLEWIGQIYPGNGNSNFNGKFKARVTLTADKSSSTAYMELSSLRS EDTAVYYCARGGRFGNAMDYWGQGTTVTVSSASTKGPSVFPLAP SSKSTSGGTAALGCLVKDYFPEPVTVSWNSGALTSGVHTFPAVLQ SSGLYSLSSVVTVPSSSLGTQTYICNVNHKPSNTKVQKRVEPKSG DKTHTCPPCPAPEREGGPSVFLFPPKPKDTLMISRTPEVTCVVVDV SHEDPEVKFNWYVDGVEVHNAKTKPREEQYNSTYRVVSVLTVLH QDWLNGKEYKCKVSNKALPASIEKTISKAKGQPREPQVCTLPPSR DELTKNQVSLTCLVEGFYPSDIAVEWESNGQPENNYKTTPPVLDS DGSFFLYSDLTVDKSRWQQGNVFSCSVMHEALHNHYTQESLSLS PGK | HC; CLND182.15, CLND182.16 |
| 410 | QVQLVQSGAEVKKPGSSVKVSCKASGYAFSSYWMNWVRQAPGQ GLEWMGQIYPGNGNSNFNGKFKARVTITADKSTSTAYMELSSLRS EDTAVYYCARGGRFGNAMDYWGQGTTVTVSSASTKGPSVFPLAP SSKSTSGGTAALGCLVKDYFPEPVTVSWNSGALTSGVHTFPAVLQ SSGLYSLSSVVTVPSSSLGTQTYICNVNHKPSNTKVDKRVEPKSC DKTHTCPPCPAPEFEGGPSVFLFPPKPKDTLMISRTPEVTCVVVDV SHEDPEVKFNWYVDGVEVHNAKTKPREEQYNSTYRVVSVLTVLH QDWLNGKEYKCKVSNKALPASIEKTISKAKGQPREPQVCTLPPSR DELTKNQVSLTCLVEGFYPSDIAVEWESNGQPENNYKTTPPVLDS DGSFFLYSDLTVDKSRWQQGNVFSCSVMHEALHNHYTQESLSLS PGK | HC; CLDN182.6, CLDN182.9 |
| 411 | DIVMTQSPDSLAVSLGERATINCKSSQSLLNSGNQKNYLTWYQK PGQPPKLLIFWASTRESGVPDRFSGSGSGTDFTLTISSLQAEDVAV YYCQNNYYYPLTFGGGTKVEIKRTVAAPSVFIFPPSDEQLKSGTAS VVCLLNNFYPREAKVQWKVDNALQSGNSQESVTEQDSKDSTYSL SSTLTLSKADYEKHKVYACEVTHQGLSSPVTKSFNRGEC | LC; CLND182.7, CLND182.13 |
| 412 | DIVMTQSPDSLAVSLGERATINCKSSQSLLNSGNQKNYLTWYQK PGQPPKLLIYWASTRESGVPDRFSGSGSGTDFTLTISSLQAEDVAV YYCQNAYFYPYTFGGGTKVEIKRTVAAPSVFIFPPSDEQLKSGTAS VVCLLNNFYPREAKVQWKVDNALQSGNSQESVTEQDSKDSTYSL SSTLTLSKADYEKHKVYACEVTHQGLSSPVTKSFNRGEC | LC; CLDN182.6, CLDN182.15 |

TABLE 20-continued

SEQUENCES

| Seq ID | sequence | name |
|---|---|---|
| 413 | DIVMTQSPDSLAVSLGERATINCKSSQSLLNSGNQKNYLTWYQQK PGQPPKLLIYWASTRESGVPDRFSGSGSGTDFTLTISSLQAEDVAV YYCQNNYFYPLTFGGGTKVEIKRTVAAPSVFIFPPSDEQLKSGTAS VVCLLNNFYPREAKVQWKVDNALQSGNSQESVTEQDSKDSTYSL SSTLTLSKADYEKHKVYACEVTHQGLSSPVTKSFNRGEC | LC; CLND182.2, CLND182.14, GUND182.17 |
| 414 | DIVMTQSPDSLAVSLGERATINCKSSQSLLNSGNQKNYLTWYQQK PGQPPKLLIYWASTRESGVPDRFSGSGSGTDFTLTISSLQAEDVAV YYCQNNYNFPLTFGGGTKVEIKRTVAAPSVFIFPPSDEQLKSGTAS VVCLLNNFYPREAKVQWKVDNALQSGNSQESVTEQDSKDSTYSL SSTLTLSKADYEKHKVYAGEVTHQGLSSPVTKSFNRGEC | LC; CLND182.1 |
| 415 | DIVMTQSPDSLAVSLGERATINCKSSQSLLNSGNQKNYLTWYQQK PGQPPKLLIYWASTRESGVPDRFSGSGSGTDFTLTISSLQAEDVAV YYCQNNYYYPLTFGGGTKVEIKRTVAAPSVFIFPPSDEQLKSGTAS VVCLLNNFYPREAKVQWKVDNALQSGNSQESVTEQDSKDSTYSL SSTLTLSKADYEKHKVYACEVTHQGLSSPVTKSFNRGEC | LC; CLDN182.3, CLND182.12 |
| 416 | DIVMTQSPDSLAVSLGERATINCKSSQSLLNSGNQRNYLTWYQQK PGQPPKLLIYWASTRESGVPDRFSGSGSGTDFTLTISSLQAEDVAV YYCQNAYFYPYTFGGGTKVEIKRTVAAPSVFIFPPSDEQLKSGTAS VVCLLNNFYPREAKVQWKVDNALQSGNSQESVTEQDSKDSTYSL SSTLTLSKADYEKHKVYACEVTHQGLSSPVTKSFNRGEC | LC; CLND182.5 |
| 417 | DIVMTQSPDSLAVSLGERATINGRSSQSLFSSGNQKNYLTWYQQK PGQPPKLLIYWASTRESGVPDRFSGSGSGADFTLTISSLQAEDVAV YYCQNDYYYPLTFGGGTKVEIKRTVAAPSVFIFPPSDEQLKSGTAS VVCLLNNFYPREAKVQWKVDNALQSGNSQESVTEQDSKDSTYSL SSTLTLSKADYEKHKVYACEVTHQGLSSPVTKSFNRGEC | LC; CLDN182.8, CLND182.11 |
| 418 | DIVMTQSPDSLAVSLGERATINGRSSQSLFSSGNQKNYLTWYQQK PGQPPKLLIYWASTRESGVPDRFSGSGSGTDFTLTISSLQAEDVAV YYCQNDYYYPLTFGGGTKVEIKRTVAAPSVFIFPPSDEQLKSGTAS VVCLLNNFYPREAKVQWKVQNALQSGNSQESVTEQDSKDSTYSL SSTLTLSKADYEKHKVYACEVTHQGLSSPVTKSFNRGEC | LC; CLND812.4, CLND182.10 |
| 419 | DIVMTQSPDSLAVSLGERATMNCKSSQSLLNSGNQKNYLTWYQQ KPGQPPKLLIYWASTRESGVPDRFSGSGSGTDFTLTISSLQAEDVA VYYCQNAYFYPYTFGGGTKVEIKRTVAAPSVFIFPPSDEQLKSGTA SVVCLLNNFYPREAKVQWKVDNALQSGNSQESVTEQDSKDSTYS LSSTLTLSKADYEKHKVYACEVTHQGLSSPVTKSFNRGEC | LC; CLND182.9, CLND182.16 |
| 420 | QVQLVQSGAEVKKPGASVKVSCKASGYTFTSYYIHWVRQAPGQG LEWIGCIYPGNVNTNYNEKFKDRATLTVDTSISTAYMELSRLRSDD TAVYFCTRSHYGLQWNFDVWGQGTTVTVSS | VH; CD28 |
| 421 | QVQLVQSGAEVKKPGASVKVSCKASGYTFTSYYIHWVRQAPGQG LEWIGSIYPGNVNTNYNEKFKDRATLTVDTSISTAYMELSRLRSDD TAVYFCTRSHYGLDWNFDVWGQGTTVTVSS | VH; CD28 (C50S) |
| 422 | QVQLVQSGAEVKKRGASVKVSCKASGYTFTSYYIHWVRQAPGQG LEWIGAIYPGNVNTNYNEKFKDRATLTVQTSISTAYMELSRLRSDD TAVYFCTRSHYGLDWNFDVWGQGTTVTVSS | VH; CD28 (C50A) |
| 423 | QVQLVQSGAEVKKPGASVKVSCKASGYTFTSYYIHWVRQAPGQG LEWIGGIYPGNVNTNYNEKFKDRATLTVDTSISTAYMELSRLRSDD TAVYFCTRSHYGLQWNFDVWGQGTTVTVSS | VH; CD28 (C50G) |
| 424 | DIQMTQSPSSLSASVGDRVTITCHASQNIYVWLNWYQQKPGKAPK LLIYKASNLHTGVPSRFSGSGSGTDFTLTISSLQPEDFATYYCQQG QTYPYTFGGGTKVEIK | VL CD28 |
| 425 | QVQLVQSGAEVKKPGASVKVSCKASGYTFTSYYIHWVRQAPGQG LEWIGCIYPGNVNTNYNEKFKDRATLTVDTSISTAYMELSRLRSDD TAVYFCTRSHYGLQWNFDVWGQGTTVTVSSASTKGPSVFPLARS SKSTSGGTAALGCLVKDYFPEPVTVSWNSGALTSGVHTFPAVLQS SGLYSLSSVVTVPSSSLGTQTYICNVNHKPSNTKVDKRVERKSCD KTHTCPPCPAPEFEGGPSVFLFPPKPKDTLMISRTPEVTCVVVDVS HEDPEVKFNWYVDGVEVHNAKTKPREFQYNSTYRVVSVLTVLHQ DWLNGKEYKCKVSNKALPASIEKTISKAKGQPREPQVCTLPPSRD ELTKNQVSLTCLVEGFYPSDIAVEWESNGQPENNYKITPPVLQSD GSFFLYSDLTVDKSRWQQGNVFSCSVMHEALHNHYTQESLSLSP GK | HC; CD28 |

TABLE 20-continued

SEQUENCES

| Seq ID | sequence | name |
|---|---|---|
| 426 | DIQMTQSPSSLSASVGDRVTITCHASQNIYVWLNWYQQKRGKAPK LUYKASNIHTGVPSRFSGSGSGTDFTLTISSLQPEDFATYYCQQG QTYPYTFGGGTKVEIKRTVAAPSVFIFPPSDEQLKSGTASVVCLLN NFYPREAKVQWKVDNALQSGNSQESVTEQDSKDSTYSLSSTLTLS KADYEKHKVYACEVTHQGLSSPVTKSFNRGEC | LC; CD28 |
| 427 | QVQLVQSGAEVKKPGASVKVSCKASGYTFTSYYIHWVRQAPGQG LEWIGCIYPGNVNTNYNEKFKDRATLTVDTSISTAYMELSRLRSDD TAVYFCTRSHYGLQWNFDVWGQGTTVTVSSGKPGSGKPGSGKP GSGKPGSDIQMTQSPSSLSASVGDRVTITCHASQNIYVWLNWYQ QKPGKAPKLLIYKASNLHTGVPSRFSGSGSGTDFTLTISSLQPEDF ATYYCQQGQTYPYTFGGGTKVEIKEPKSSDKTHTCPPCPAPEFEG GPSVFLFPPKPKDTLMISRTPEVTCVVVDVSHEDPEVKFNWYVDG VEVHNAKTKPREEQYNSTYRVVSVLTVLHQDWLNGKEYKCKVSN KALPASIEKTISKAKGQPREPQVYTLPPCRKKLTKNQVSLTCLVKG FYPSDIAVEWESNGQPENNYKTTPPVLKSDGSFFLYSKLTVDKSR WQQGNVFSCSVMHEALHNHYTQKSLSLSPGK | CD28 Scfv-Fc |
| 428 | QVQLVQSGAFVKKPGASVKVSCKASGYTFTSYYIHWRQAPGQG LEWIGGIYPGNVNTNYNEKFKDRATLTVDTSISTAYMELSRLRSDD TAVYFCTRSHYGLQWNFDVWGQGTTVTVSSGKPGSGKPGSGKP GSGKPCSDIQMTQSPSSLSASVGDRVTITCHASQNIYVWLNWYQ QKPGKAPKLLIYKASNLHTGVPSRFSGSGSGTDFTLTISSLQPEDF ATYYCQQGQTYPYTFGGGTKVEIKERKSSDKTHTCPPCPAPEFEG GPSVFLFPPKPKDTLMISRTPEVTCVVVDVSHEDPEVKFNWYVDG VEVHNAKTKPREEQYNSTYRVVSVLTVLHQDWLNGKEYKCKVSN KALPASIEKTISKAKGQPREPQVYTLPPCRKKLTKNQVSLTCLVKG FYPSDIAVEWESNGQPENNYKTTPPVLKSDGSFFLYSKLTVDKSR WQQGNVFSCSVMHEALHNHYTQKSLSLSPGK | CD28 (C50G) Scfv-Fc |
| 429 | QVQLVQSGAEVKKPGASVKVSCKASGYTFTSYYIHWVRQAPGQG LEWIGAIYPGNVNTNYNEKFKDRATLTVDTSISTAYMELSRLRSDD TAVYFCTRSHYGLQWNFDVWGQGTTVTVSSGKPGSGKPGSGKP GSGKPGSDIQMTQSPSSLSASVGDRVTITCHASQNIYVWLNWYQ QKPGKAPKLLIYKASNLHTGVPSRFSGSGSGTDFTLTISSLQPEDA ATYYCQQGQTYPYTFGGGTKVEIKEPKSSDKTHTCPPCPAPEFEG GPSVFLFPPKPKDTLMISRTPEVTCVVVDVSHEDPEVKFNWYVDG VEVHNAKTKPREEQYNSTYRVVSVLTVLHQDWLNGKEYKCKVSN KALPASIEKTISKAKGQPREPQVYTLPPCRKKLTKNQVSLTCLVKG FYPSDIAVEWESNGQPENNYKTTPPVLKSDGSFFLYSKLTVDKSR WQQGNVFSCSVMHEALHNHYTQKSLSLSPGK | CD28 (C50A) scfv-Fc |
| 430 | QVQLVQSGAEVKKPGASVKVSCKASGYTFTSYYIHWVRQAPGQG LEWIGSIYPGNVNTNYNEKFKDRATLTVDTSISTAYMELSRLRSDD TAVYFCTRSHYGLDWNFDVWGQGTTVTVSSGKPGSGKPGSGKP GSGKPGSDIQMTQSPSSLSASVGDRVTITCHASQNIYVWLNWYQ QKPGKAPKLLIYKASNLHTGVPSRFSGSGSGTDFTITISSLQPEDF ATYYCQQGQTYPYTFGGGTKVEIKERKSSDKTHTCPPCPAPEFEG GPSVFLFPPKPKDTLMISRTPEVTCVVVDVSHEDPEVKENWYVDG VEVHNAKTKPREEQYNSTYRVVSVILTVLHQDWLNGKEYKCKVSN KALPASIEKTISKAKGQPREPQVYTLPPCRKKLTKNQVSLTCLVKG FYPSDIAVEWESNGQPENNYKTTPPVLKSDGSFFLYSKLTVDKSR WQQGNVFSCSVMHEALHNHYTQKSLSLSPGK | CD28 (C50S) scfv-Fc |
| 431 | QVQLVQSGAEVKKPGASVKVSCKASDYTFSNYYIEWVRQAPGQG LEWMGEILPGNGNTVYNEKFKDRVTMTVDTSTSTAYMELRSLRSD DTAVYYCARWGDYALFANWGQGTLVTVSSGGGGGGGSGGG GSDIQMTQSPSTLSASVGDRVTITCKASQNVGTNVAWYQQKPGK APKALIYSASYRYSGVPSRFSGSGSGTEFTLTISSLQPDDFATYYC QQYNSYPFTFGQGTKLEIKERKSSDKTHTCPPCPAPEFEGGPSVF LFPPKPKDTLMISRTPEVTCVVVDVSHEDPEVKFNWYVDGVEVHN AKTKPREEQYNSTYRVVSVLTVLHQDWLNGKEYKCKVSNKALPAS IEKTISKAKGQPREPQVYTLPPCRKKLTKNQVSLTCLVKGFYPSDIA VEWESNGQPENNYKTTPPVLKSDGSFFLYSKLTVDKSRWQQGNV FSCSVMHEALNNHYTQKSLSLSPGK | DLL3scfv-Fc |
| 432 | QVQLVQSGAEVKKPGASVKVSCKASGYTFTDYFMNWVRQAPGQ GLEWMGVINPYNDITIYNQKFQGRVTMTVQRSTSTVYMELSSLRS EDTAVYYCAREGVLYDGYYEGAYWGQGTLVTVSSGGGGSGGGG SGGGGSDIQLTQSPSFLSASVGDRVTITCKASQNVGIAVAWYQQK PGKAPKLLIYAASNRYTGVPSRFSGSGSGTEFTLTISSLQPEDFAT YYCQQYSTYPYTFGQGTKLEIKERKSSDKTHTCPPCPAPEFEGGP SVFLAPPKPKDTLMISRTPEVTCVVVDVSHEDPEVKFNWYVDGVE VHNAKTKPREEQYNSTYRVVSVLTVLHQDWLNGKEYKCKVSNKA LPASIEKTISKAKGQPREPQVYTLPPCRKKLTKNQVSLTCLVKGFY | DLL3scfv-Fc |

TABLE 20-continued

SEQUENCES

| Seq ID | sequence | name |
|---|---|---|
| | PSDIAVEWESNGQPENNYKTTPPVLKSDGSFFLYSKLTVQKSRWQ<br>QGNVFSCSVMHEALHNHYTQKSLSLSPGK | |
| 433 | QVQLVQSGAEVKKPGASVKVSCKATDYIFSNYYIEWVRQAPGQGL<br>EWMGEILPGTGNTVYNEKFKDRVTMTVDTSTSTVYMELSSLRSED<br>TAVYYCARWGDYALFANWGQGTLVTVSSGGGGGGGGGSGGGG<br>SDIQMTQSPSFLSASVGDRVTITCKASQNVGTNVAWYQQKGKAP<br>KPLYSTSYRYSGVPSRFSGSGSGTEFTLTISSLQPEDFATYYCQQ<br>YNNYPLTFGGGTKVEIKERKSSDKTHTCPPCPAPEFEGGPSVFLFR<br>PKPKDTLMISRTPEVTCVVVDVSHEDPEVKFNWYVDGVEVHNAKT<br>KPREEQYNSTYRVVSVLTVLHQDWLNGKEYKCKVSNKALPASIEK<br>TISKAKGQPREPQVYTLPPCRKKLTKNQVSLTCLVKGFYPSDIAVE<br>WESNGQPENNYKTTPPVLKSDGSFFLYSKLTVDKSRWQQGNVFS<br>CSVMMEALMNMYTQKSLSLSPGK | DLL3scfv-<br>Fc |
| 434 | QVQLVQSGAEVKKPGASVKVSCKATDYIFSNYYIEWWVRQAPGQGL<br>EWMGEILPGTGNTVYNEKFKDRVTMTVDTSTSTVYMELSSLRSED<br>TAVYYCARWGDYALFANWGQGTLVTVSSGGGGGGGGGSGGGG<br>SDIQMTQSPSTLSASVGDRVTITCKASQNVGTNVAWYQQKPGKAP<br>KALIYSASYRYSGVPSRFSGSGSGTEFTLTISSLQPDDFATYYCQQ<br>YNSYPFTFGQGTKLEIKEPKSSDKTHTCFPCPAPEFEGGPSVFLFP<br>PKPKDTLMISRTPEVTCVVVDVSHEDPEVKFNWYVDGVEVHNAKT<br>KPREEQYNSTYRVVSVLTVLHQDWLNGKEYKCKVSNKALPASIEK<br>TISKAKGQPREPQVYTLPPCRKKLTKNQVSLTCLVKGFYPSDIAVE<br>WESNGQPENNYKTTPPVLKSDGSFFLYSKLTVDKSRWQQGNVFS<br>CSVMHEALHNMYTQKSLSLSPGK | DLL3scfV-<br>Fc |
| 435 | QVQLVQSGAEVKKPGASVKVSCKASGYTFTSYYIHWVRQAPGQC<br>LEWIGSIYPGNVNTNYNEKFKDRATLTVDTSISTAYMELSRLSDD<br>TAVYFCTRSHYGLQWNFDVWGQGTTVTVSSGKPGSGKPGSGKP<br>GSGKPGSDIQMTQSPSSLSASVGDRVTITCHASQNIYVWLNWYQ<br>QKPGKAPKLLIYKASNLHTGVPSRFSGSGSGTDFTLTISSLQPEDF<br>ATYYCQQGQTYPYTFGCGTKVEIKERKSSDKTHTCPPCPAPEFEG<br>GPSVFLFPPKPKDTLMISRTPEVTCVVVDVSHEDPEVKFNWYVDG<br>VEVHNAKTKPREEQYNSTYRVVSVLTVLHQDWLNGKEYKCKVSN<br>KALPASIEKTISKAKGQPREPQVYTLPPCRKKLTKNQVSLTCLVKG<br>FYPSDIAVEWESNGQPENNYKTTPPVLKSDGSFFLYSKLTVDKSR<br>WQQGNVFSCSVMHEALHNHYTQKSLSLSPGK | CD28<br>(C50S)<br>Scfv(CC)-Fc |
| 436 | QVQLVQSGAEVKKPGASVKVSCKASGYTFTSYYIHWVRQAPGQG<br>LEWIGSIYPGNVNTNYNEKFKDRATLTVDTSISTAYMELSRLRSDD<br>TAVYFCTRSHYGLQWNFDVWGQGTTVTVSSGGGGGGGGSGG<br>GGSGGGGSDIQMTQSPSSLSASVGDRVTITCHASQNIYVWLNWY<br>QQKPGKAPKLLIYKASNLHTGVPSRFSGSGSGTDFTLTISSLQPED<br>FATYYCQQGQTYPYTFGGGTKVEIKERKSSDKTHTCPPCPAREFE<br>GGPSVFLPPPKPKDTLMISRTPEVTGVVVDVSHEDPEVKPNWYVD<br>GVEVHNAKTKPREEQYNSTYRVVSVLTVLNQDWINGKEYKCKVS<br>NKALPASIEKTISKAKGQPREPQVYTLPPCRKKLTKNQVSLTCLVK<br>GFYPSDIAVEWESNGQPENNYKTTPPVLKSDGSFFLYSKLTVDKS<br>RWQQGNVFSCSVMHEALHNHYTQKSLSLSPGK | CD28<br>(C50S)-<br>Scfv(G4S)-<br>Fc |
| 437 | QVQLQQWGAGLLKPSETLSLTCAVYGGSFSGYYWSWIRQSPEKG<br>LEWIGEINHGGYVTYNPSLESRVTISVDTSKNQFSLKLSSVTAADTA<br>VYYCARDYGPGNYDWYFDLWGRGTLVTVSSASTKGPSVFPLAPS<br>SKSTSGGTAALGCLVKDYFPEPVTVSWNSGALTSGVHTFPAVLQS<br>SGLYSLSSVVTVPSSSIGTQTYICNVNHKPSNTKVDKRVEPKSCD<br>KTHTCPPCPAPEFEGGPSVFLFPPKPKDTLMISRTPEVTCVVVDVS<br>HEDPEVKFNWYVDGVEVHNAKTKPREEQYNSTYRVVSVLTVLHQ<br>DWLNGKEYKCKVSNKALPASIEKTISKAKGQPREPQVCTLPPSRD<br>ELTKNQVSLTCLVEGFYPSDIAVEWESNGQPENNYKTTPPVLDSD<br>GSFFLYSDLTVDKSRWQQGNVFSCSVMHEALHNHYTQESLSLSP<br>GK | HC;<br>CD137.U |
| 438 | EIVLTQSPATLSLSPGERATLSCRASQSVSSYLAWYQQKPGQAPR<br>LUIYDASNRATGIPARFSGSGSGTDFTLTISSLEPEDFAVYYCQQRS<br>NWPPALTFGGGTKVEIKRTVAAPSVFIFPPSDEQLKSGTASVVCLL<br>NNFYPREAKVQWKVDNALQSGNSQESVTEQDSKDSTYSLSSTLT<br>LSKADYEKHKVYACEVTHQGLSSPVTKSFNRGEC | LC;<br>CD137.U |
| 439 | QVQLVQSGAEVKKPGASVKVSCKASGYTESSYWMHWVRQAPGQ<br>RLEWMGEINPGNGHTNYSQKFQGRVTITVDKSASTAYMELSLRS<br>EDTAVYYCARSFTTARAFAYWGQGTLVTVSSASTKGPSVFPLAPS<br>SKSTSGGTAALGCLVKDYPPEPVTVSWNSGALTSGVHTFPAVLQS<br>SGLYSLSSVVTVPSSSIGTQTYICNVNHKPSNTKVQKRVEPKSCD<br>KTHTCPPCPAPEFEGGPSVFLFPPKPKDTLMISRTPEVTGVVVDVS<br>HEDPEVKFNWYVDGVEVHNAKTKPREEQYNSTYRVVSVLTVLHQ | HC;<br>CD137.B |

TABLE 20-continued

SEQUENCES

| Seq ID | sequence | name |
|---|---|---|
| | DWLNGKEYKCKVSNKALPASIEKTISKAKGQPREPQVCTLPPSRD<br>ELTKNQVSLTGLVEGFYPSDIAVEWESNGQPENNYKTTPPVLDSD<br>GSFFLYSDLTVDKSRWQQGNVFSCSVMHEALHNHYTQESLSLSP | |
| 440 | DIVMTQSPPTLSLSPGERVTLSCRASQSISDYLHWYQQKPGQSPR<br>LUKYASQSISGIPARFSGSGSGTDFTLTISSLEPEDFAVYYCQDGH<br>SFPPTFGGGTKVEIKRTVAAPSVFIFPPSDEQLKSGTASVVQLLNN<br>FYPREAKVQWKVDNALQSGNSQESVTEQDSKDSTYSLSSTLTLSK<br>ADYEKHKVYACEVTHQGLSSPVTKSFNRGEC | LC;<br>CD137.B |
| 441 | QVQLQQWGAGLLKPSETLSLTCAVYGGSFSGYYWSWIRQSPEKG<br>LEWIGEINHGGYVTYNPSLESRVTISVDTSKNQFSLKLSSVTAADTA<br>VYYCARDYGPGNYDWYFDLWGRGTLVTVSSGKPGSGKPGSGKP<br>SGKPGSEIVLTQSPATLSLSPGERATLSCRASQSVSSYLAWYQQ<br>KPGQAPRLLIYDASNRATGIPARFSGSGSGTDFTLTISSLEPEDFAV<br>YYCQQRSNWPPALTFGGGTKVEIKEPKSSDKTHTCPPCPAPEFEG<br>GPSVFLFPPKPKDTLMISRTPEVTCVVVDVSHEDPEVKFNWYVDG<br>VEVHNAKTKPREEQYNSTYRVVSVLTVLHQDWLNGKEYKCKVSN<br>KALPASIEKTISKAKGQPREPQVYTLPPCRKKLTKNQVSLTCLVKG<br>FYPSDIAVEWESNGQPENNYKTTPPVLKSDGSFFLYSKLTVDKSR<br>WQQGNVFSCSVMHEALHNHYTQKSLSLSPGK | CD137.U<br>scfv(CL)-Fc |
| 442 | QVQLQQWGAGLLKPSETLSLTCAVYGGSFSGYYWSWIRQSPEKG<br>LEWIGEINHGGYVTYNPSLESRVTISVDTSKNQFSLKLSSVTAADTA<br>VYYCARDYGPGNYDWYFDLWGRGTLVTVSSGGGGGGGGGGGG<br>GGSEIVLTQSPATLSLSPGERATLSCRASQSVSSYLAWYQQKPGQ<br>APRLLIYDASNRATGIPARFSGSGSGTDFTLTISSLEPEDFAVYYCQ<br>QRSNWPPALTFGGGTKVEIKREPKSSDKTHTCPPCPAPEFEGGPS<br>VFLFPPKPKDTLMISRTPEVTCVVVDVSHEDPEVKFNWYVDGVEV<br>HNAKTKPREEQYNSTYRVVSVLTVLHQDWINGKEYKCKVSNKAL<br>PASIEKTISKAKGQPREPQVYTLPPCRKKLTKNQVSLTCLVKGFYP<br>SDIAVEWESNGQPENNYKITPPVLKSDGSFFLYSKLTVQK<br>GNVFSCSVMHEALHNHYTQKSLSLSPGK | CD137.U<br>scfv(G4S)-<br>Fc |
| 443 | QVQLQQWGAGLLKPSETLSLTCAVYGGSFSGYYWSWIRQSPEKG<br>LEWIGEINHGGYVTYNPSLESRVTISVQTSKNQFSLKLSSVTAADTA<br>VYYCARDYGPGNYDWYFDLWGRGTLVTVSSGGGGGGGGGGGG<br>GGSGGGGGGGGSGGGGSEIVLTQSPATLSLSFGERATLSCRAS<br>QSVSSYLAWYQQKPGQAPRLLIYDASNRATGIPARFSGSGSGTDF<br>TLTISSLEPEDFAVYYCQQRSNWPPALTFGGGTKVEIKEPKSSDKT<br>HTCPPCPAPEFEGGPSVFLFPPKPKDTLMISRTPEVTCVVVDVSHE<br>DPEVKFNWYVDGVEVHNAKTKPREEQYNSTYRVVSVLTVLHQDW<br>LNGKEYKCKVSNKALPASIEKTISKAKGQPREPQVYTLPPCRKKLT<br>KNQVSLTCLVKGFYPSDIAVEWESNGQPENNYKTTPPVLKSDGSF<br>FLYSKLTVDKSRWQQGNVFSCSVMHEALHNHYTQKSLSLSPGK | CD137.U<br>scfv (6x)-Fc |
| 444 | EIVLTQSPATLSLSPGERATLSCRASQSVSSYLAWYQQKPGQAPR<br>LUIYDASNRATGIPARFSGSGSGTDFTLTISSLEPEDFAVYYCQQRS<br>NWPPALTFGGGTKVEIKGKPGSGKPGSGKPGSGKPGSQVQLQQ<br>WGAGLLKPSETLSLTCAVYGGSFSGYYWSWIRQSPEKGLEWIGEI<br>NHGGYVTYNPSLESRVTISVDTSKNQFSLKLSSVTAADTAVYYCAR<br>DYGPGNYDWYFDLWGRGTLVTVSSEPKSSDKTHTCPPCPAPEFE<br>GGPSVFLFPPKPKDTLMISRTPEVTCVVVDVSHEDPEVKFNWYVD<br>GVEVHNAKTKPREEQYNSTYRVVSVLTVLHQDWLNGKEYKCKVS<br>NKALPASIEKTISKAKGQPREPQVYTLPPCRKKLIKNQVSLTCLVK<br>GFYPSDIAVEWESNGQPENNYKTTPPVLKSDGSFFLYSKLTVDKS<br>RWQQGNVFSCSVMHEALHNHYTQKSLSLSPGK | CD137.U<br>scfv(VLVH)<br>Fc |
| 445 | QVQLQQWGAGLLKPSETLSLTCAVYGGSFSGYYWSWIRQSPEKG<br>LEWIGEINHGGYVTYNPSLESRVTISVDTSKNQFSLKLSSVTAADTA<br>VYYCARDYGPGNYDWYFDLWGRGTLVTVSSGGGGSGGGGSGG<br>GGSEIVLTQSPATLSLSPGERATLSCRASQSVSSYLAWYQQKPGQ<br>APRLLIYDASNRATGIPARFSGSGSGTDFTLTISSLEPEDFAVYYCQ<br>QRSNWPPALTFSGGTKVEIKREPKSSDKTHTCPFCPAPEFEGGPS<br>VFLFPPKPKDTLMISRTPEVTCVVVDVSHEDPEVKFNWYVDGVEV<br>HNAKTKPREEQYNSTYRVVSVLTVLHQDWLNGKEYKCKVSNKAL<br>PASIEKTISKAKGQPREPQVYTLPPCRKKLTKNQVSLTCLVKGFYP<br>SDIAVEWESNGQPENNYKTTPPVLKSDGSFFLYSKLTVDKSRWQQ<br>GNVFSCSVMHEALHNHYTQKSLSLSPGK | CD137.U(G<br>99S) scfv-<br>Fc |
| 446 | QVQLQESGPGLVKPSETLSLTCTVSGGSFSGYYWSWIRQPPGKG<br>LEWIGEINHGGYVTYNPSLESRVTISVDTSKNQFSLKLSSVTAADTA<br>VYYCARDYGPGNYDWYFDLWGRGTLVTVSSGKPGSGKPGSGKP<br>GSGKPGSEIVLTQSPGTLSLSPGERATLSCRASQSVSSSYLAWYQ<br>QKPGQAPRLLIYDASNRATGIFDRFSGSGSGTDFTLTISRLEPEDF<br>AVYYCQQRSNWPPALTFGGGTKVEIKEPKSSDKTHTCPPCPAPEF | CD137.Uv1<br>scfv-Fc |

TABLE 20-continued

SEQUENCES

| Seq ID | sequence | name |
|---|---|---|
| | EGGPSVFLFPPKPKDTLMISRTPEVTCVVVDVSHEDPEVKFNWYV DGVEVHNAKTKPREEQYNSTYRVVSVLTVLHQDWLNGKEYKCKV SNKALPASIEKTISKAKGQPREPQVYTLPPCRKKLTKNQVSLTCLV KGFYPSDIAVEWESNGQPENNYKTTPPVLKSDGSFFLYSKLTVDK SRWQQGNVFSCSVMHEALHNHYTQKSLSLSPGK | |
| 447 | EVQLLESGGGLVQPGGSLRLSCAASGGSFSGYYWSWVRQAPGK GLEWWVSEINHGGYVTYNPSLESRFTISRDNSKNTLYLQMNSLRAE DTAVYYCAKDYGPGNYDWYFDLWGRGTLVTVSSGKPGSGKPGS GKPGSGKPGSEIVLTQSPGTLSLSPGERATLSCRASQSVSSSYLA WYQQKPGQAPRLLIYDASNRATGIPDRESGSGSGTDFTLTISRLER EDFAVYYCQQRSNWPPALTFGGGTKVEIKEPKSSDKTHTCPPCPA PEFEGGPSVFLFPPKPKDTLMISRTPEVTCVVVDVSHEDPEVKEN WYVDGVEVHNAKTKPREEQYNSTYRVVSVLTVLHQDWLNGKEYK CKVSNKALPASIEKTISKAKGQPREPQVYTLPPCRKKLTKNQVSLT CLVKGFYPSDIAVEWESNGQPENNYKTTPRVLKSDGSFFLYSKLT VDKSRWQQGNVFSCSVMHEALHNHYTQKSLSLSPGK | CD137.Uv2 scfv-Fc |
| 448 | QVQLVQSGAEVKKPGSSVKVSCKASGGSFSGYYWSWVRQAPGQ GLEWMGEINHGGYVTYNPSLESRVTITADESTSTAYMELSSLRSE DTAVYYCARDYGPGNYDWYFDLWGRGTLVTVSSGKPGSGKPGS GKPGSGKPGSEIVLTQSPGTLSLSPGERATLSGRASQSVSSSYLA WYQQKPGQAPRLLIYDASNRATGIPDRFSGSGSGTDFTLTISRLEP EDFAVYYCQQRSNWPPALTFGGGTKVEIKEPKSSDKTHTCPPCPA PEFEGGPSVFLFPPKPKDTLMISRTPEVTCVVVDVSHEDPEVKEN WYVDGVEVHNAKTKPREEQYNSTYRVVSVLTVLHQDWLNGKEYK CKVSNKALPASIEKTISKAKGQPREPQVYTLPPCRKKLTKNQVSLT CLVKGFYPSDIAVEWESNGQPENNYKTTPPVLKSDGSFFLYSKLT VDKSRWQQGNVFSCSVMHEALHNHYTQKSLSLSPGK | CD137.Uv3 scfv-Fc |
| 449 | QVQLQQWGAGLLKPSETLSLTCAVYGGSFSGYYWSWIRQSPEKC LEWIGEINHGGYVTYNPSLESRVTISVDTSKNQFSLKLSSVTAADTA VYYCARDYGPGNYDWYFDLWGRGTLVTVSSGKPGSGKPGSGKP GSGKPGSEIVLTQSPATLSLSPGERATLSCRASQSVSSYLAWYQQ KPGQAPRLLIYDASNRATGIPARFSGSGSGTDFTLTISSLEPEDFAV YYCQQRSNWPPALTFGCGTKVEIKEPKSSDKTHTCPPCPAPEFEG GPSVFLFPPKPKDTLMISRTPEVTCVVVDVSHEDPEVKFNWYVDG VEVHNAKTKPREEQYNSTYRVVSVLTVLHQDWLNGKEYKCKVSN KALPASIEKTISKAKGQPREPQVYTLPPCRKKLTKNQVSLTCLVKG FYPSDIAVEWESNGQPENNYKTTPPVLKSDGSFFLYSKLTVDKSR WQQGNVFSCSVMHEALHNHYTQKSLSLSPGK | CD137 |
| 450 | QVQLGQWGAGLLKPSETLSLTCAVYGGSFSGYYWSWIRQSPEKC LEWIGEINHGGYVTYNPSLESRVTISVDTSKNQFSLKLSSVTAADTA VYYCARDYGPGNYDWYFDLWGRGTLVTVSSGKPGSGKPGSGKP GSGKPGSEIVLTQSPATLSLSPGERATLSCRASQSVSSSYLAWYQQ KPGQAPRLLIYDASNRATGIPARFSGSGSGTDFTLTISSLEPEDFAV YYCQQRSNWPPALTFGCGTKVEIKEPKSSDKTHTCPPCPAPEFEG GPSVFLFPPKPKDTLMISRTPEVTCVWDVSHEDPEVKFNWYVDG VEVHNAKTKPREEQYNSTYRVVSVLTVLHQDWLNGKEYKCKVSN KALPASIEKTISKAKGQPREPQVYTLPPCRKKLTKNQVSLTCLVKG FYPSDIAVEWESNGQPENNYKTTPPVLKSDGSFFLYSKLTVDKSR WQQGNVFSCSVMHEALHNHYTQKSLSLSPGK | CD137.U scfv(CC)-Fc |
| 451 | QVQLVQSGAEVKKPGASVKVSCKASGYTFSSYWMHWRQAPGQ RLEWMGEINPGNGHTNYSQKFQGRVTITVDKSASTAYMELSSLRS EDTAVYYCARSFTTARAFAYWGQGTLVTVSSGKPGSGKPGSGKP GSGKPGSDIVMTQSPPTLSLSPGERVTLSCRASQSISDYLHWYQQ KPGQSPRLLIKYASQSISGIPARFSGSGSGTDFTLTISSLEPEDFAV YYCQDGHSFPPTFGGGTKVEIKEPKSSDKTHTCPPCPAPEFEGGP SVFLFPPKPKDTLMISRTPEVTCVVVDVSHEDPEVKFNWYVDGVE VHNAKTKPREEQYNSTYRVVSVLTVLHQDWLNGKEYKCKVSNKA LPASIEKTISKAKGQPREPQVYTLPPCRKKLTKNQVSLTCLVKGFY PSDIAVEWESNGQPENNYKTTPPVLKSDGSFFLYSKLTVDKSRWQ QGNVFSCSVMHEALMNHYTQKSLSLSPGK | CD137.B scfv-Fc |
| 452 | QVQLVQSGAEVKKPGASVKVSCKASGYTFSSYWMHWRQAPGQ RLEWMGEINPGNGHTNYAQKFQGRVTITVDKSASTAYMELSSLRS EDTAVYYCARSFTTARAFAYWGQGTLVTVSSGKPGSGKPGSGKP GSGKPGSDIVMTQSPPTLSLSPGERVTLSCRASQSISDYLHWYQQ KPGQSPRLLIKYASQSISGIPARFSGSGSGTDFTLTISSLEPEDFAV YYCQDGHSFPPTFGGGTKVEIKEPKSSDKTHTCPPCPAPEFEGGP SVFLFPPKPKDTLMISRTPEVTCVVVDVSHEDPEVKFNWYVDGVE VHNAKTKPREEQYNSTYRVVSVLTVLHQDWLNGKEYKCKVSNKA LPASIEKTISKAKGQPREPQVYTLPPCRKKLTKNQVSLTCLVKGFY | CD137.b(S60A) scfv-fc |

TABLE 20-continued

SEQUENCES

| Seq ID | sequence | name |
|---|---|---|
| | PSDIAVEWESNGQPENNYKTTPPVLKSDGSFFLYSKLTVDKSRWQ QGNVFSCSVMHEALMNHYTQKSLSLSPGK | |
| 453 | QVQLVQSGAEVKKPGASVKVSCKASGYTFSSYWMHWVRQAPGQ RLEWMGEINPGNGHTNYNQKFQGRVTITVDKSASTAYMELSSLRS EDTAVYYCARSFTTARAFAYWGQGTLVTVSSGKPGSGKPGSGKP GSGKPGSDIVMTQSPPTLSLSPGERVTLSCRASQSISDYLHWYQQ KPGQSPRLLIKYASQSISGIPARFSGSGSGTDFTLTISSLEPEDFAV YYCQDGHSFPPTFGGGTKVEIKEPKSSDKTHTCPPCPAPEFEGGP SVFLFPPKPKDTLMISRTPEVTCVVVDVSHEDPEVKPNWYVDGVE VHNAKTKPREEQYNSTYRVVSVLTVLHQDWLNGKEYKCKVSNKA LPASIEKTISKAKGQPREPQVYTLPPCRKKLTKNQVSLTCLVKGFY PSDIAVEWESNGQPENNYKTTPPVLKSDGSFFLYSKLTVDKSRWQ QGNVFSCSVMHEALHNHYTQKSLSLSPGK | CD137.B (S50N) scfv-fc |
| 454 | EVQLVESGGGLVQPGGSLRLSCAASGFTFSDYWMSWVRQAPGK GLEWVADIKNDGSYTNYAPSLTNRFTISRDNAKNSLYLQMNSLRA EDTAVYYCARELTGTWGQGTMVTVSSGKPGSGKPGSGKPGSGK PGSDIVMTQSPDSLAVSLGERATINCKSSQSLLSSGNQKNYLAWY QQKPGQPPKLLIYYASTRQSGVPDRFSGSGSGTDFTLTISSLQAED VAVYYCLQYDRYPFTFGQGTKLEIKEPKSSDKTHTCPPCPAPEFE GGPSVFLFPPKPKDTLMISRTPEVTCVVVDVSHEDPEVKFNWYVD GVEVHNAKTKPREEQYNSTYRVVSVLTVLHQDWLNGKEYKCKVS NKALPASIEKTISKAKGQPREPQVYTLPPCRKKLTKNQVSLTCLVK GFYPSDIAVEWESNGQPENNYKTTPPVLKSDGSFFLYSKLTVDKS RWQQGNVFSCSVMHEALHNHYTQKSLSLSPGK | CD137.39 scfv-Fc |
| 455 | EVQLVESGGGLVQPGGSLRLSCAASGFTFSDYWMSWVRQAPGK GLEWVADIKNDGSYTNYVDSVKGRFTISRDNAKNSLYLQMNSLRA EDTAVYYCARELTGTWGQGTLVTVSSGKPGSGKPGSGKPGSGKP GSDIIMTQSPDSLAVSLGERATINCKSSQSLLSSGNQKNYLAWYQ QKPGQPPELLIYYASTRQSGVPDRFSGSGSGTDFTLTISSLQAEDV AVYYCLQYDRYPFTEGQGTKLEIKERKSSDKTHTCPPCPAPEFEG GPSVFLFPPKPKDTLMISRTPEVTCVVVDVSHEDPEVKENWYVDG VEVHNAKTKPREEQYNSTYRVVSVLTVLHQDWLNGKEYKCKVSN KALPASIEKTISKAKGQPREPQVYTLPPCRKKLTKNQVSLTCLVKG FYPSDIAVEWESNGQPENNYKTTPPVLKSDGSFFLYSKLTVDKSR WQQGNVFSCSVMHEALHNHYTQKSLSLSPGK | CD137.39v 1 scfv-Fc |
| 456 | EVQLVESGGGLVQPGGSLRLSCAASGFTFSDYWMSWVRQAPGK GLEWVADIKNDGSYTNYVDSVKGRFTISRDNAKNSLYLQMNSLRA EDTAVYYCARELTGTWGQGTLVTVSSGKPGSGKPGSGKPGSGKP GSDIVMTQSPDSLAVSLGERATINCKSSQSLLSSGNQKNYLAWYQ QKPGQPPKLUIYYASTRQSGVPDRFSGSGSGTDFTLTISSLQAEDV AVYYCLQYDRYPFTEGQGTKLEIKERKSSDKTHTCPPCPAPEFEG GPSVFLFPPKPKDTLMISRTPEVTCVVVDVSHEDPEVKENWYVDG VEVHNAKTKPREEQYNSTYRVVSVLTVLHQDWLNGKEYKCKVSN KALPASIEKTISKAKGQPREPQVYTLPPCRKKLTKNQVSLTCLVKG FYPSDIAVEWESNGQPENNYKTTPPVLKSDGSFFLYSKLTVDKSR WQQGNVFSCSVMHEALHNHYTQKSLSLSPGK | CD137.39v 2 scfv-Fc |
| 457 | EVQLVESGGGLVQPGGSLRLSCAASGFTFSDYWMSWVRQAPGK GMEWVGDIKNDGSYTNYAPSLTNRFTISRDNARNSLYLQMNSLRA EDTAVYYCTRELTGTWGQGTLVTVSSGKPGSGKPGSGKPGSGKP GSDIIMTQSPDSLAVSLGERATINCKSSQSLLSSGNQKNYLAWYQ QKPGQPPELLIYYASTRQSGVPDRFSGSGSGTDFTLTISSLQAEDV AVYYCLQYDRYPFTEGQGTKLEIKERKSSDKTHTCPPCPAPEFEG GPSVFLFPPKPKDTLMISRTPEVTCVVVDVSHEDPEVKENWYVQG VEVHNAKTKPREEQYNSTYRVVSVLTVLHQDWLNGKEYKCKVSN KALPASIEKTISKAKGQPREPQVYTLPPCRKKLTKNQVSLTCLVKG FYPSDIAVEWESNGQPENNYKTTPPVLKSDGSFFLYSKLTVDKSR WQQGNVFSCSVMHEALHNHYTQKSLSLSPGK | CD137.39v 3 scfv-Fc |
| 458 | EVQLVESGGGLVQPGGSLRLSCAASGFTFSDYWMSWVRQAPGK GMEWVGDIKNDGSYTNYAPSLTNRFTISRDNARNSLYLQMNSLRA EDTAVYYCTRELTGTWGQGTLVTVSSGKPGSGKPGSGKPGSGKP GSDIVMTQSPDSLAVSLGERATINCKSSQSLLSSGNQKNYLAWYQ QKPGQPPKLUYYASTRQSGVPDRFSGSGSGTDFTLTISSLQAEDV AVYYCLQYDRYPFTFGQGTKLEIKEPKSSDKTHTCPPCPAPEFEG GPSVFLFPPKPKDTLMISRTPEVTCVVVDVSHEDPEVKFNWYVDG VEVHNAKTKPREEQYNSTYRVVSVLTVLHQDWLNGKEYKCKVSN KALPASIEKTISKAKGQPREPQVYTLPPCRKKLTKNQVSLTCLVKG FYPSDIAVEWESNGQPENNYKTTPPVLKSDGSFFLYSKLTVDKSR WQQGNVFSCSVMHEALHNHYTQKSLSLSPGK | CD137.39V 4 scfv-Fc |

TABLE 20-continued

SEQUENCES

| Seq ID | sequence | name |
|---|---|---|
| 459 | QVKLVESGAEVKKPGASVKVSCKASGYTFTSYWMHWVRQAPGQ VLEWMGEINPGNGHTSYAQKFQGRVTLTVDKSTSTAYMELSSLRS EDTAVYYCARSFTTARAFAYWGQGTTVTVSSGKPGSGKPGSGKP GSCKPGSDIQMTQSPSSLSASVGDRVTITCRASQSISDYLHWYQQ KPGKAPKLLIKYASQSISGVPSRFSGSGSGTDFTLTISSLQPEDFAT YYCQDSHSFPPTFGGGTKVEIKERKSSDKTHTCPPCPAPEFEGGP SVFLFPPKPKDTLMISRTPEVTCVVVDVSHEDPEVKENWYVDGVE VHNAKTKPREEQYNSTYRVVSVLTVLHQDWLNGKEYKCKVSNKA LPASIEKTISKAKGQPREPQVYTLPPCRKKLTKNQVSLTCLVKGFY PSDIAVEWESNGQPENNYKTTPPVLKSDGSFFLYSKLTVDKSRWQ QGNVFSCSVMHEALHNHYTQKSLSLSPGK | CD137.Bv1 scfv-Fc |
| 460 | QVKLVESGAEVKKPGASVKVSCKASGYTFTSYWMHWVRQAPGQ VLEWMGEINPGNGHTSYAQKFQGRVTLTVDKSTSTAYMELSSLRS EDTAVYYCARSFTTARAFAYWGQGTTVTVSSGKPGSGKPGSGKP GSGKPGSDIVMTQSPPTLSLSPGERVTLSCRASQSISDYLHWYQQ KPGQSPRLLIKYASQSISGIPARFSGSGSGTDFTLTISSLEPEDFAV YYCQDGHSFPPTFGGGTKVEIKEPKSSDKTHTCPPCPAPEFEGGP SVFLFPPKPKDTLMISRTPEVTCVVVDVSHEDPEVKFNWYVDGVE VHNAKTKPREEQYNSTYRVVSVLTVLHQDWLNGKEYKCKVSNKA LPASIEKTISKAKGQPREPQVYTLPPCRKKLTKNQVSLTCLVKGFY PSDIAVEWESNGQPENNYKTTPPVLKSDGSFFLYSKLTVDKSRWQ QGNVFSCSVMHEALHNHYTQKSLSLSPGK | CD137.Bv2 scfv-fc |
| 461 | QVQLVQSGAEVKKLSCKASGYTFSSYWMEIWVRQAPGQ GLEMGEINPGNGHTNYNEKFKSRVTMTRDTSTSTAYMELSSLRS EDTAVYYCARSFKTARAFAYWGQGTLVTVSSGKPGSGKPGSGKP GSGKPGSDIVMTQSPAFLSVTRGEKVTITCRASQTISDYLHWYQQ KPDQAPKLUKYASQSISGIPSRFSGSGSGTDFTFTISSLEAEDAAT YYCQDGHSWPPTFGQGTKLEIKEPKSSDKTHTCPPCPAPEFEGG PSVFLFPPKPKDTLMISRTPEVTCVVVDVSHEDPEVKFNWYVDGV EVHNAKTKPREEQYNSTYRVVSVLTVLHQDWLNGKEYKCKVSNK ALPASIEKTISKAKGGPREPQVYTLPPCRKKLTKNQVSLTCLVKGF YPSDIAVEWESNGQPENNYKTTPPVLKSDGSFFLYSKLTVDKSRW QQGNVFSCSVMHEALHNHYTQKSLSLSPGK | CD137.Bv3 scfv-fc |
| 462 | QVQLVQSGAEVKKPGASVKVSCKASGYTFTSYWMHWVRQAPGQ GLEWMGIINPGNGHTSYAQKFQGRVTMTRDTSTSTVYMELSSLRS EDTAVYYCARSFTTARAFAYWGQGTTVTVSSGKPGSGKPGSGKP GSGKPGSDIQMTQSPSSLSASVGDRVTITGRASQSISDYLHWYQQ KPGKAPKLLIKYASQSISGVPSRFSGSGSGTDFTLTISSLQPEDFAT YYCQDSHFPPTFGGGTKVEIKEPKSSDKTHTCPPCPAPEFEGGP SVFLFPPKPKDTLMISRTPEVTCVVVDVSHEDPEVKFNWYVDGVE VHNAKTKPREEQYNSTYRVVSVLTVLHQDWLNGKEYKCKVSNKA LPASIEKTISKAKGQPREPQVYTLPPCRKKLTKNQVSLTCLVKGFY PSDIAVEWESNGQPENNYKTTPPVLKSDGSFFLYSKLTVDKSRWQ QGNVFSCSVMHEALHNHYTQKSLSLSPGK | CD137.Bv4 scfv-fc |
| 463 | QVQLVQSGAEVKKPGASVKVSCKASGYTFTSYWMHWVRQAPGQ GLEWMGIINPGNGHTSYAQKFQGRVTMTRDTSTSTVYMELSSLRS EDTAVYYCARSFTTARAFAYWGQGTTVTVSSGKPGSGKPGSGKP GSGKPGSDIVMTQSPPTLSLSPGERVTLSCRASQSISDYLHWYQQ KPGQSPRLLIKYASQSISGIPARFSGSGSGTDFTLTISSLEPEDFAV YYCQDGHSFPPTFGGGTKVEIKEPKSSDKTHTCPPCPÅPEFEGGP SVFLFPPKPKDTLMISRTPEVTCVVVDVSHEDPEVKFNWYVDGVE VHNAKTKPREEQYNSTYRVVSVLTVLHQDWLNGKEYKCKVSNKA LPASIEKTISKAKGQPREPQVYTLPPCRKKLTKNQVSLTCLVKGFY PSDIAVEWESNGQPENNYKTTPPVLKSDGSFFLYSKLTVDKSRWQ QGNVFSCSVMHEALHNHYTQKSLSLSPGK | CD137.Bv5 scfv-fc |
| 464 | QVQLVQSGAEVKKPGASVKVSCKASGYTFTSYWMHWVRQAPGQ RLEWMGEINPSNGHTKYSQKFQGRVTITVDKSASTAYMELSSLRS EDTAVYYCARSFTTARAFAYWGQGTLVTVSSGKPGSGKPGSGKP GSGKPGSDIQMTQSPSSLSASVGDRVTITCRASQSISDYLHWYQQ KPGKAPKLLIKYASQSISGVPSRFSGSGSGTDFTLTISSLQPEDFAT YYCQDSHSFPPTFGGGTKVEIKEPKSSDKTHTCPPCPAPEFEGGP SVFLFPPKPKDTLMISRTPEVTCVVVDVSHEDPEVKFNWYVDGVE VHNAKTKPREEQYNSTYRVVSVLTVLHQDWLNGKEYKCKVSNKA LPASIEKTISKAKGQPREPQVYTLPPCRKKLTKNQVSLTCLVKGFY PSDIAVEWESNGQPENNYKTTPPVLKSDGSFFLYSKLTVDKSRWQ QGNVFSCSVMHEALHNHYTQKSLSLSPGK | CD137.Bv6 |
| 465 | QVQLVQSGAEVKKPGASVKVSCKASGYTFTSYWMHWVRQAPGQ RLEWMGEINPSNGHTKYSQKFQGRVTITVDKSASTAYMELSSLRS EDTAVYYCARSFTTARAFAYWGQGTLVTVSSGKPGSGKPGSGKP | CD137.Bv7 scfv-fc |

TABLE 20-continued

| Seq ID | sequence | name |
|---|---|---|
| | GSGKPGSDIVMTQSPPTLSLSPGERVTLSCRASQSISDYLHWYQQ KPGQSPRLLIKYASQSISGIPARFSGSGSGTDFTLTISSLEPEDFAV YYCQDGHSFPPTFGGGTKVEIKEPKSSDKTHTCPPCPAPEFEGGP SVFLFPPKPKDTLMISRTPEVTCVVVDVSHEDPEVKFNWYVDGVE VHNAKTKPREEQYNSTYRVVSVLTVLHQDWLNGKEYKCKVSNKA LPASIEKTISKAKGQPREPQVYTLPPCRKKLTKNQVSLTCLVKGFY PSDIAVEWESNGQPENNYKTTPPVLKSDGSFFLYSKLTVDKSRWQ QGNVFSCSVMHEALHNHYTQKSLSLSPGK | |
| 466 | QVQLVQSGAEVKKPGASVKVSCKASGYTFTDYFMNWVRQAPGQ CLEWMGVINPYNDITIYNQKFQGRVTMTVDRSTSTVYMELSSLRS EDTAVYYCAREGVLYDGYYEGAYWGQGTLVTVSSGKPGSGKPG SGKPGSGKPGSDIQLTQSPSFLSASVGDRVTITCKASQNVGIAVA WYQQKPGKAPKLLIYAASNRYTGVPSRFSGSGSGTEFTLTISSLQP EDFATYYCQQYSTYPYTFGCGTKLEIKEPKSSGKTHTCPPCPAPER EGGPSVFLFPPKPKDTLMISRTPEVTCVVVDVSHEDPEVKENWYV DGVEVHNAKTKPREEQYNSTYRVVSVLTVLHQDWLNGKEYKCKV SNKALPASIEKTISKAKGQPREPQVYTLPPCRKKLTKNQVSLTCLV KGFYPSDIAVEWESNGQPENNYKTTPPVLKSDGSFFLYSKLTVDK SRWQQGNVFSCSVMHEALHNHYTQKSLSLSPGK | DLL3 scfv-Fc |
| 467 | EVQLLESGGGLVQPGGSLRLSCAASGFTFSSYGMHWVRQAPGK GLEWVAVISHHGSSKYYADSVKGRFTISRDNSKNTLYLQMNSLRA EDTAVYYCARDWFFYLFDYWGQGTLVTVSSGKPGSGKPGSGKP GSGKPGSDIVMTQSPLSLPVTPGEPASISCKSSQSLLHSDGKTFLY WYLQKPGQSPQLLIYEVSNRFSGVPDRFSGSGSGTDFTLKISRVE AEDVGVYYCLQGERLPFTFGQGTKVEIKEPKSSDKTHTCPPCPAP EFEGGRSVFLFPPKPKDTLMISRTPEVTCVVVDVSHEDPEVKFNW YVDGVEVHNAKTKPREEQYNSTYRVVSVLTVLHQDWLNGKEYKC KVSNKALPASIEKTISKAKGQPREPQVYTLPPCRKKLTKNQVSLTC LVKGFYPSDIAVEWESNGQPENNYKTTPPVLKSDGSFFLYSKLTV DKSRWQQGNVFSCSVMHEALHNHYTQKSLSLSPGK | DLL3 scfv-Fc |
| 468 | QVQLVQSGAEVKKPGASVKVSCKASGYTFTDYFMNWVRQAPGQ GLEWMGVINPYNDITIYNQKFQGRVTMTVDRSTSTVYMELSSLRS EDTAVYYCAREGVLYDGYYEGAYWGQGTLVTVSSGGGGSGGGG SGGGGSDIQLTQSPSFLSASVGDRVTITCKASQNVGIAVAWYQQK PCKAPKLLIYAASNRYTGVPSRFSGSGSGTEFTLTISSLQPEDFAT YYCQQYSTYPYTFGQGTKLEIKSGGGGSQVQLVQSGAEVKKPGA SVKVSCKASGYTFSSYWMHWRQAPGQRLEWMGEINPGNGHTN YSQKFQGRVTITVDKSASTAYMELSSLRSEDTAVYYCARSFTTARA FAYWGQGTLVTVSSGKPGSGKPGSGKPGSDIVMTQSPPT LSLSPGERVTLSCRASQSISDYLHWYQQKPGQSPRLLIKYASQSIS GIPARFSGSGSGTDFTLTISSLEPEDFAVYYCQDGHSFPPTFGGGT KVEIKEPKSSDKTHTCPPCPAPEFEGGPSVFLFPPKPKDTLMISRT PEVTCVVVDVSHEDPEVKFNWYVDGVEVHNAKTKPREEQYNSTY RVVSVLTVLHQDWLNGKEYKCKVSNKALPASIEKTISKAKGQPREP QVYTLPPCRKKLTKNQVSLTCLVKGFYPSDIAVEWESNGQPENNY KTTPPVLKSDGSFFLYSKLTVDKSRWQQGNVFSCSVMHEALHNH YTQKSLSLSPGK | DLL3scFv-41BBscFv-fc x 41BBFab-fc |
| 469 | QVQLVQSGAEVKKPGASVKVSCKASGYTFSSYWMHWVRQARGQ RLEWMGEINPGNGHTNYSQKFQGRVTITVDKSASTAYMELSSLRS EDTAVYYCARSFTTARAFAYWGQGTLVTVSSGGGGGGGGGGGG GGSGGGGSDIVMTQSPPTLSLSPGERVTLSCRASQSISDYLHWYQ QKPGQSPRLLIKYASQSISGIPARFSGSGSGTDFTLTISSLEPEDFA VYYCQDGHSFPPTFGGGTKVEIKSGGGGSQVQLVQSGAEVKKPG ASVKVSCKASGYTFSSYWMHWRQAPGQRLFWMGFINPGNGHT NYSQKFQGRVTITVDKSASTAYMELSSLRSEDTAVYYCARSFTTA RAFAYWGQGTLVTVSSGKPGSGKPGSGKPGSGKPGSDIVMTQSP PTLSLSPGERVTLSCRASQSISDYLHWYQQKPGQSPRLLIKYASQS ISGIPARFSGSGSGTDFTLTISSLEPEDFAVYYCQDGHSFPPTFGG GTKVEIKEPKSSDKTHTCPPCPAPEFEGGPSVFLFPPKPKDTLMIS RTPEVTCVVVDVSHEDPEVKFNWYVDGVEVHNAKTKPREEQYNS TYRVVSVLTVLHQDWLNGKEYKCKVSNKALPASIEKTISKAKGQPR EPQVYTLPPCRKKLTKNQVSLTCLVKGFYPSDIAVEWESNGQPEN NYKTTPPVLKSDGSFFLYSKLTVDKSRWQQGNVFSCSVMHEALH NHYTQKSLSLSPGK | 4-1BBscFv-41BBscFv-Fc X DLL3Fab-Fc |
| 470 | QVQLVQSGAEVKKPGASVKVSCKASGYTFSSYWMHWVRQAPGQ RLEWMGEINPGNGHTNYSQKFQGRVTITVDKSASTAYMELSSLRS EDTAVYYCARSFTTARAFAYWGQGTLVTVSSASTKGPSVFPLAPS SKSTSGGTAALGCLVKDYFPEPVTVSWNSGALTSGVHTFPAVLQS SGLYSLSSVVTVPSSSLGTQTYICNVNHKPSNTKVDKRVEPKSCD KTHTCPPCPAPEFEGGPSVFLFPPKPKDTLMISRTPEVTCVVVDVS HEDPEVKFNWYVDGVEVHNAKTKPREEQYNSTYRVVSVLTVLHQ | 41BBFab-Fc-DLL3scFv |

TABLE 20-continued

SEQUENCES

| Seq ID | sequence | name |
|---|---|---|
| | DWLNGKEYKCKVSNKALPASIEKTISKAKGQPREPQVCTLPPSRD<br>ELTKNQVSLTCLVEGFYPSDIAVEWESNGQPENNYKTTPPVLDSD<br>GSFFLYSDLTVDKSRWQQGNVFSCSVMHEALHNHYTQESLSLSP<br>GKSGGGGSQVQLVQSGAEVKKPGASVKVSCKASGYTFTDYFMN<br>WVRQAPGQGLEWMGVINPYNDITIYNQKFQGRVTMTVQRSTSTV<br>YMELSSLRSEDTAVYYCAREGVLYDGYYEGAYWGQGTLVTVSSG<br>GGGSGGGGSGGGGSDIQLTQSPSFLSASVGDRVTITCKASQNVGI<br>AVAWYQQKPGKAPKLLIYAASNRYTGVPSRFSGSGSGTEFTLTISS<br>LQPEDFATYYCQQYSTYPYTFGQGTKLEIK | |
| 471 | QVQLQQWGAGLLKPSETLSLTCAVYGGSESGYYWSWIRQSPEKG<br>LEWIGEINHGGYVTYNPSLESRVTISVQTSKNQFSLKLSSVTAADTA<br>VYYCARDYGPGNYDWYFDLWGRGTLVTVSSASTKGPSVFPLAPS<br>SKSTSGGTAALGCLVKDYFREPVTVSWNSGALTSGVHTFPAVLQS<br>SGLYSLSSVVTVPSSSLGTQTYICNVNHKPSNTKVDKRVEPKSCD<br>KTHTCPPCPAPEFEGGPSVFLFPPKPKDTLMISRTPEVTCVVVDVS<br>HEDPEVKFNWYVDGVEVHNAKTKPREEQYNSTYRVVSVLTVLHQ<br>DWLNGKEYKCKVSNKALPASIEKTISKAKGQPREPQVYTLPPCRK<br>KLTKNQVSLTCLVKGFYPSDIAVEWESNGQPENNYKTTPPVLKSD<br>GSFFLYSKLTVDKSRWQQGNVFSCSVMHEALHNHYTQKSLSLSP<br>GKSGGGGSQVQLVQSGAEVKKPGASVKVSCKASGYTFTDYFMN<br>WRQAPGQGLEWMGVINPYNDITIYNQKFQGRVTMTVDRSTSTV<br>YMELSSLRSEDTAVYYCAREGVLYDGYYEGAYWGQGTLVTVSSG<br>GGGSGGGGSGGGGSDIQITQSPSFLSASVGDRVTITCKASQNVGI<br>AVAWYQQKPGKAPKLLIYAASNRYTGVPSRFSGSGSGTEFTLTISS<br>LQPEDFATYYCQQYSTYPYTFGQGTKLEIK | 41BBFab-<br>Fc-<br>DLL3scFv |
| 472 | QVQLVQSGAEVKKPGASVKVSCKASGYTFSSYWMHWVRQAPGQ<br>RLEWMGEINPGNGHTNYSQKFQGRVTITVDKSASTAYMELSSLRS<br>EDTAVYYCARSFTTARAFAYWGQGTLVTVSSASTKGPSVFPLAPS<br>SKSTSGGTAALGCLVKDYFPEPVTVSWNSGALTSGVHTFPAVLQS<br>SGLYSLSSVVTVPSSSLGTQTYICNVNHKPSNTKVDKRVERKSCD<br>KTHTCPPCPAPEFEGGPSVFLFPPKPKDTLMISRTPEVTCVVVDVS<br>HEDPEVKPNWYVDGVEVHNAKTKPREEQYNSTYRVVSVLTVLHQ<br>DWLNGKEYKCKVSNKALPASIEKTISKAKGQPREPQVYTLPPCRK<br>KLTKNQVSLTCLVKGFYPSDIAVEWESNGQPENNYKTTPPVLKSD<br>GSFFLYSKLTVDKSRWQQGNVFSCSVMHEALHNHYTQKSLSLSP<br>GKSGGGGSQVQLVQSGAEVKKPGASVKVSCKASGYTFTDYFMN<br>WVRQAPGQGLEWMGVINPYNDITIYNQKFQGRVTMTVDRSTSTV<br>YMELSSLRSEDTAVYYCAREGVLYDGYYEGAYWGQGTLVTVSSG<br>GGGGGGGGGGGGSDIQLTQSPSFLSASVGDRVTITCKASQNVGI<br>AVAWYQQKPCKAPKLLIYAASNRYTGVPSRFSGSGSGTEFTLTISS<br>LQPEDFATYYCQQYSTYPYTFGQGTKLEIK | 41BBFab-<br>DLL3scFv |
| 473 | QVQLQQWGAGLLKPSETLSLTCAVYGGSFSGYYWSWIRQSPEKG<br>LEWIGEINHGGYVTYNPSLESRVTISVDTSKNQFSLKLSSVTAADTA<br>VYYCARDYGPGNYDWYFDLWGRGTLVTVSSASTKGPSVFPLAPS<br>SKSTSGGTAALGCLVKDYFPEPVTVSWNSGALTSGVHTFPAVLQS<br>SGLYSLSSVVTVPSSSLGTQTYICNVNHKPSNTKVDKRVEPKSCD<br>KTHTCPPCPAPEFEGGPSVFLFPPKPKDTLMISRTPEVTCVVVDVS<br>HEDPEVKFNWYVDGVEVHNAKTKPREEQYNSTYRVVSVLTVLHQ<br>DWLNGKEYKCKVSNKALPASIEKTISKAKGQPREPQVCTLPPSRD<br>ELTKNQVSLTCLVEGFYPSDIAVEWESNGQPENNYKTTPPVLDSD<br>GSFFLYSDLTVDKSRWQQGNVFSCSVMHEALHNHYTQESLSLSP<br>GKSGGGGSQVQLVQSGAEVKKPGASVKVSCKASGYTFTDYFMN<br>WVRQAPGQGLEWMGVINPYNDITTYNQKFQGRVTMTVQRSTSTV<br>YMELSSLRSEDTAVYYCAREGVLYDGYYEGAYWGQGTLVTVSSG<br>GGGGGGGSGGGGSDIQLTQSPSFLSASVGDRVTITCKASQNVGI<br>AVAWYQQKPGKAPKLLIYAASNRYTGVPSRFSGSGSGTEFTLTISS<br>LQPEDFATYYCQQYSTYPYTFGQGTKLEIK | 41BBFab-<br>Fc-<br>DLL3scFv |
| 474 | EVQLVQSGAEVKKPGESLKISCKGSGYEFSSHWMNWVRQMPGK<br>CLEWMGQIYPGDGDINYNEKFRGQVTISADKSISTAYLQWSSLKAS<br>DTAMYYCARHGNYVMDYWGQGTLVTVSSGKPGSGKPGSGKPGS<br>GKPGSIQLTQSPSFLSASVGDRVTITCSASSSVSYMFWYQQKPGK<br>APKPWYRTSNLASGVPSRFSGSGSGTEFTLTISSLQPEDFATYYC<br>QQFHDYPRTFGCGTKVEIKEPKSSDKTHTCPPCPAPEFEGGPSVF<br>LFPPKPKDTLMISRTPEVTCVVVDVSHEDPEVKFNWYVDGVEVHN<br>AKTKPREEQYNSTYRVVSVLTVLHQDWLNGKEYKCKVSNKALPAS<br>IEKTISKAKGQPREPQVYTLPPCRKKLTKNQVSLTCLVKGFYPSDIA<br>VEWESNGQPENNYKTTPPVLKDSGSFFLYSKLTVDKSRWQQGNV<br>FSCSVMHEALHNHYTQKSLSLSPGK | Muc17scfv-<br>fc |
| 475 | QVQLVQSGAEVKKPGASVKVSCKASGYTFTNFGITWVRQAPGQG<br>LEWMGETYPSSQNTFYNEKFKGRVTMTTDTSTSTAYMELRSLRSD<br>DTAVYYCARGGGPLRSRYFDYWGQGTLVTVSSGKPGSGKPGSG | CLDN182.<br>scfv-Fc |

TABLE 20-continued

| Seq ID | sequence | name |
|---|---|---|
| | KPGSGKPGSDIVMTQSPDSLAVSLGERATINGRSSQSLFSSGNQK NYLTWYQQKPGQPPKLLIYWASTRESGVPDRFSGSGSGTDFTLTI SSLQAEDVAVYYCQNDYYYPLTFGGGTKVEIKEPKSSDKTHTCFP CPAPEFEGGPSVFLFPPKPKDTLMISRTPEVTCVVVDVSHEDPEVK FNWYVDGVEVHNAKTKPREEQYNSTYRVVSVLTVLHQDWLNGKE YKCKVSNKALPASIEKTISKAKGQPREPQVYTLPPCRKKLTKNQVS LTCLVKGFYPSDIAVEWESNGQPENNYKTTPPVLKSDGSFFLYSKL TVDKSRWQQGNVFSCSVMHEALHNHYTQKSLSLSPGK | |
| 476 | EVQLVESGGGLVQPGGSLRLSCAASGFTFSSFGMHWWRQAPGK GLEWWSYISSGNSAIYYADTVNGRFTISRDNAKNSLYLQMNSLRAE DTAVYYCARLRYGNSFDYWGQGTLVTVSSGKPGSGKPGSGKPG SGKPGSDIVMTQSPDSLAVSLGERATINCKSSQSLLNSGNQKNYL TWYQQKPGQPPKLLIYWASTRESGVPDRFSGSGSGTDFTLTISSL QAEDVAVYYCQNNYYYPLTFGGGTKVEIKEPKSSDKTHTCPPGRA PEFEGGPSVFLFPPKPKDTLMISRTPEVTCVVVDVSHEDPEVKEN WYVDGVEVHNAKTKPREFQYNSTYRVVSVLTVLHQDWLNGKEYK CKVSNKALPASIEKTISKAKGQPREPQVYTLPPCRKKLTKNQVSLT CLVKGFYPSDIAVEWESNGQPENNYKTTPPVLKSDGSFFLYSKLT VDKSRWQQGNVFSCSVMHEALHNHYTQKSLSLSPGK | CLDN182. scfv-Fc |
| 477 | QVQLVQSGAEVKKPGSSVKVSCKASGYAFNNYWMNWVRQAPGQ GLEWMGQISPGNGNSNFNGKFKGRVTITADKSTSTAYMELSSLRS EDTAVYYCARGGRYGNAMDYWGQGTTVTVSSGKPGSGKPGSGK PGSGKPGSDIVMTQSPDSLAVSLGERATINCKSSQSLLNSGNQRN YLTWYQQKPGQPPKLLIYWASTRESGVPDRFSGSGSGTDFTLTIS SLQAEDVAVYYCQNAYFYPYTFGGGTKVEIKEPKSSDKTHTCPPC PAPEFEGGPSVFLFPPKPKDTLMISRTPEVTCVVVDVSHEDPEVKF NWYVDGVEVHNAKTKPREEQYNSTYRVVSVLTVLHQDWLNGKEY KCKVSNKALPASIEKTISKAKGQPREPQVYTLPPCRKKLTKNQVSL TCLVKGFYPSDIAVEWESNGQPENNYKTTPPVLKSDGSFFLYSKLT VDKSRWQQGNVFSCSVMHEALHNHYTQKSLSLSPGK | CLDN182. scfv-Fc |
| 478 | QVQLVQSGAEVKKPGASVKVSCKASGYTFTNSGMNWVRQAPGQ GLEWMGWINTNTGEPTFAEEFRGRVTMTRDTSISTAYMELSRLRS DDTAVYYCARYYYGNSFAYWGQGTLVTVSSGKPGSGKPGSGKP GSGKPGSDIVMTQSPDSLAVSLGERATINCKSSQSLLNSGNQKNY LTWYGQKPGQPPKLUYWASTRESGVPDRFSGSGSGTDFTLTISS LQAEDVAVYYCQNNYFYPLTFGGGTKVEIKEPKSSDKTHTCPPCP APEFEGGPSVFLPPPKPKDTLMISRTPEVTCVVVDVSHEDPEVKFN WYVDGVEVHNAKTKPREEQYNSTYRVVSVLTVLHQDWLNGKEYK CKVSNKALPASIEKTISKAKGQPREPQVYTLPPCRKKLTKNQVSLT CLVKGFYPSDIAVEWESNGQPENNYKITPPVLKSDGSFFLYSKLT VDKSRWQQGNVFSCSVMHEALHNHYTQKSLSLSPGK | CLDN182. scfv-Fc |
| 479 | QVQLVQSGAEVKKPGASVKVSCKASGYTFTSYWMHWVRQAPGQ GLEWMGIINPGNGHTSYAQKFQGRVTMTRDTSTSTVYMELSSLRS EDTAVYYCARSFTTARAFAYWGQGTTVTVSSGKPGSGKPGSGKP GSGKPGSDIQMTQSPSSLSASVGDRVTITCRASQSISDYLHWYQQ KPGKAPKLLIKYASQSISGVPSRFSGSGSGTDFTLTISSLQPEDFAT YYCQDSHSFPPTFGGGTKVEIKEPKSSDKTHTCPPCPAPEFEGGR SVFLFPPKPKDTLMISRTPEVTCVVVDVSHEDPEVKFNWYVDGVE VHNAKTKPREEQYNSTYRVVSVLTVLHQDWLNGKEYKCKVSNKA LPASIEKTISKAKGQPREPQVYTLPPCRKKLTKNQVSLTCLVKGFY PSDIAVEWESNGQPENNYKTTPPVLKSDGSFFLYSKLTVDKSRWQ QGNVFSCSVMHEALHNHYTQKSLSLSPGK | CD137.bV8 scfv-Fc |
| 480 | EVQLVESGGGLVQPGGSLRLSCAASGFTFSTYAMNWVRQAPGK GLEWVGRIRSKYNNYATYYADSVKGRFTISRDDSKNTLYLQMNSL RAEDTAVYYCVRHGNFGDSYVSWFEYWGQGTLVTVSSGGGGSG GGGSGGGGSGGGGSQAVVTQERSLTVSPGGTVTLTCGSSTGAV TTSNYANWVQQKPGKSPRGLIGGTNKRAPGVPARFSGSLLGGKA ALTISGAQPEDEADYYCALWYSNHWVFGGGTKLTVLSGGGGSQV QLVQSGAEVKKPGASVKVSCKASGYTFTSYYIHWRQAPGQGLE WIGSIYPGNVNTNYNEKFKDRATLTVDTSISTAYMELSRLRSDDTA VYFCTRSHYGLDWNFDVWGQGTTVTVSSGKPGSGKPGSGKPGS GKPGSDIQMTQSPSSLSASVGDRVTITCHASQNIYVWLNWYQQKP GKAPKLLIYKASNLHTGVPSRFSGSGSGTDFTLTISSLQPEDFATYY CQQGQTYPYTFGGGTKVEIKEPKSSDKTHTCPPCPAPEFEGGPSV FLFPPKPKDTLMISRTPEVTCVVVDVSHEDPEVKFNWYVDGVEVH NAKTKPREEQYNSTYRVVSVLTVLHQDWLNGKEYKCKVSNKALPA SIEKTISKAKGQPREPQVYTLPPCRKKLTKNQVSLTCLVKGFYPSDI AVEWESNGQPENNYKTTPPVLKSDGSFFLYSKLTVDKSRWQQGN VFSCSVMHEALHNHYTQKSLSLSPGK | CD3scfv- CD28scfv- Fc |

TABLE 20-continued

SEQUENCES

| Seq ID | sequence | name |
|---|---|---|
| 481 | QVQLVQSGAEVKKPGASVKVSCKASGYTFTSYYIHWVRQAPGQG LEWIGSIYPGNVNTNYNEKFKDRATLTVDTSISTAYMELSRLSDD TAVYFCTRSHYGLQWNFDVWGQGTTVTVSSGKPGSGKPGSGKP GSGKPGSDIQMTQSPSSLSASVGDRVTITCHASQNIYVWLNWYQ QKPGKAPKLLIYKASNLHTGVPSRFSGSGSGTDFTLTISSLQPEDF ATYYCQQGQTYPYTFGGGTKVEIKSGGGGSEVQLVESGGGLVQR GGSLRLSCAASGFTFSTYAMNWVRQAPGKGLEWVGRIRSKYNNY ATYYADSVKGRFTISRDDSKNTLYLQMNSLRAEDTAVYYCVRHGN FGDSYVSWFEYWGQGTLVTVSSGGGGSGGGGGGGGGGGS QAVVTQFPSLTVSPGGTVTLTCGSSTGAVTTSNYANWVQQKPGK SPRGLIGGTNKRAPGVPARFSGSLLGGKAALTISGAQPEDEADYY CALWYSNHWVFGGGTKLTVLEPKSSDKTHTCPPCPAPEFEGGPS VFLFPPKPKDTLMISRTPEVTCVVVDVSHEDPEVKFNWYVDGVEV HNAKTKPREEQYNSTYRVVSVLTVLHQDWLNGKEYKCKVSNKAL PASIEKTISKAKGQPREPQVYTLPPCRKKLTKNQVSLTCLVKGFYP SDIAVEWESNGQPENNYKTTPPVLKSDGSFFLYSKLTVDKSRWQQ GNVFSCSVMHEALHNHYTQKSLSLSPGK | CD28scfv-CD3scfv-Fc |
| 482 | DVQLQESGPGLVKPSQSLSLTCTVTGYSITSDYAWNWIRQFPGNK LEWMGYIRYSGSTSYNPSLKSRISITRDTSKNQFFLQLNSVTTEDT ATYYCARDWPRPSYWYFDVWGAGTTVTVSSASTKGPSVFPLAPS SKSTSGGTAALGCLVKDYFPEPVTVSWNSGALTSGVHTFPAVLQS SGLYSLSSVVTVPSSSLGTQTYICNVNHKPSNTKVDKRVEPKSCD KTHTCPPCPAPEFEGGPSVFLFPPKPKDTLMISRTPEVTGVVVDVS HEDREVKFNWYVDGVEVHNAKTKPREEQYNSTYRVVSVLTVLHQ DWLNGKEYKCKVSNKALPASIEKTISKAKGQPREPQVCTLPPSRD ELTKNQVSLTCLVEGFYPSDIAVEWESNGQPENNYKTTPPVLDSD GSFFLYSDLTVDKSRWQQGNVFSCSVMHEALHNHYTQESLSLSP GK | HC; CD28 |
| 483 | DIQTTQTTSSLSASLGDRVTISCRAGQDISNYLNWYQQKPDGTVKL LIYYTSRLHSGVPSRFSGSGSGTDYSLTISNLEQEDIATYFCQQGH TLPWTFGGGTKLEIKRTVAAPSVFIFPPSDEQLKSGTASVVCLLNN FYPREAKVQWKVDNALQSGNSQESVTEQDSKDSTYSLSSTLTLSK ADYEKHKVYACEVTHQGLSSPVTKSFNRGEC | LC-CD28 |
| 484 | EVQLVESGGGLVQPGGSLRLSCAASGFTFSDYWMSWVRQAPGK GLEWVADIKNDGSYTNYAPSLINRFTISRDNAKNSLYLQMNSLRA EDTAVYYCARELTGTWGQGTMVTVSBGGGGSGGGGGGGGSG GGGSDIVMTQSPDSLAVSLGERATINCKSSQSLLSSGNQKNYLAW YQQKPGQPPKLLIYYASTRQSGVPDRFSGSGSGTDFTLTISSLQAE DVAVYYCLQYDRYPFTFGQGTKLEIKSGGGGSEVQLVESGGGLV QPGGSLRLSCAASGFTFSTYAMNWVRQAPGKGLEWVGRIRSKYN NYATYYADSVKGRFTISRDDSKNTLYLQMNSLRAEDTAVYYCVRH GNFGDSYVSWFEYWGQGTLVTVSSGKPGSGKPGSGKPGSGKPG SQAVVTQEPSLTVSPGGTVTLTCGSSTGAVTTSNYANWVQQKPG KSPRGLIGGTNKRAPGVPARFSGSLLGGKAALTISGAQPEDEADY YCALWYSNHWVFGGGTKLTVLEPKSSDKTHTCPPCPAPEFEGGP SVFLFPPKPKDTLMISRTPEVTCVVVDVSHEDPEVKENWYVDGVE VHNAKTKPREEQYNSTYRVVSVLTVLHQDWLNGKEYKCKVSNKA LPASIEKTISKAKGQPREPQVYTLPPCRKKLTKNQVSLTCLVKGFY PSDIAVEWESNGQPENNYKTTPPVLKSDGSFFLYSKLTVDKSRWQ QGNVFSCSVMHEALHNHYTQKSLSLSPGK | CD137.39scfv-CD3scfv-Fc |
| 486 | QVQLVQSGAEVKKPGASVKVSCKASGYTFSSYWMHWVRQAPGQ RLEWMGEINPGNGHTNYSQKFQGRVTITVDKSASTAYMELSSLRS EDTAVYYCARSFTTARAFAYWGQGTLVTVSSGGGGGGGGGGG GGSGGGGSDIVMTQSPPTLSLSPGERVTLSCRASQSISDYLHWYQ QKPGQSPRLLIKYASQSISGIPARFSGSGSGTDFTLTISSLEPEDFA VYYCQDGHSFPPTFGGGTKVEIKSGGGGSEVQLVESGGGLVQPG GSLRLSCAASGFTFSTYAMNWVRQAPGKGLEWVGRIRSKYNNYA TYYADSVKGRFTISRDDSKNTLYLQMNSLRAEDTAVYYCVRHGNF GDSYVSWFEYWGQGTLVTVSSGKPGSGKPGSGKPGSGKPGSQA VVTQFPSLTVSPGGTVTLTCGSSTGAVTTSNYANWVQQKPGKSP RGLIGGTNKRAPGVPARFSGSLLGGKAALTISGAQPEDEADYYCA LWYSNHWVFGGGTKLTVLEPKSSDKTHTCPPCPAPEFEGGPSVF LFPPKPKDTLMISRTPEVTCVVVDVSHEDPEVKFNWYVDGVEVHN AKTKPREEQYNSTYRVVSVLTVLHQDWLNGKEYKCKVSNKALPAS IEKTISKAKGQPREPQVYTLPPCRKKLTKNQVSLTCLVKGFYPSDIA VEWESNGQPENNYKTTPPVLKSDGSFFLYSKLTVDKSRWQQGNV FSCSVMHEALHNHYTQKSLSLSPGK | CD137.b scfv-CD3scfv-Fc |
| 487 | QVQLQQWGAGLLKPSETLSLTCAVYGGSFSGYYWSWIRQSPEKG LEWIGEINHGGYVTYNPSLESRVTISVDTSKNQFSLKLSSVTAADTA VYYCARDYGPGNYDWYFDLWGRGTLVTVSSASTKGPSVFPLARS | CD137.U-Fc-CD3scfv |

TABLE 20-continued

SEQUENCES

| Seq ID | sequence | name |
|---|---|---|
|  | SKSTSGGTAALGCLVKDYFPEPVTVSWNSGALTSGVHTFPAVLQS SGLYSLSSVVTVPSSSLGTQTYICNVNHKPSNTKVDKRVERKSCD KTHTCPPCPAPEFEGGPSVFLFPPKPKDTLMISRTPEVTCVVVDVS HEDPEVKFNWYVDGVEVHNAKTKPREEQYNSTYRVVSVLTVLHQ DWLNGKEYKCKVSNKALPASIEKTISKAKGQPREPQVYTLPPCRK LTKNQVSLTCLVKGFYPSDIAVEWESNGQPENNYKTTPPVLKSD GSFFLYSKLTVDKSRWQQGNVFSCSVMHEALHNHYTQKSLSLSP GKSGGGGSEVQLVESGGGLVQPGGSLRLSCAASGFTFSTYAMN VWRQAPGKGLEWVGRIRSKYNNYATYYADSVKGRFTISRDDSKN TLYLQMNSLRAEDTAVYYCVRHGNFGDSYVSWFEYWGQGTLVTV SSGGGGGGGGSGGGSGGGGSQAVVTQERSLTVSPGGTVTLT CGSSTGAVTTSNYANWVQQKPGKSPRGLIGGTNKRAPGVPARFS GSLLGGKAALTISGAQPEDEADYYCALWYSNHWWFGGGTKLTVL |  |
| 488 | EPKSSDKTHTCPPCPAPEFEGGPSVFLFPPKPKDTUMISRTPEVTC VVVDVSHEDPEVKFNWYVDGVEVHNAKTKPREEQYNSTYRVVSV LTVLHQDWLNGKEYKCKVSNKALPASIEKTISKAKGQPREPQVCTL PPSRDELTKNQVSLTCLVEGFYPSDIAVEWESNGQPENNYKTTPP VLDSDGSFFLYSDLTVDKSRWQQGNVFSCSVMHEALHNHYTQES LSLSPGKSGGGSQVQLVQSGAEVKKPGASVKVSCKASGYTFSSY WMHWVRQAPGQRLEWMGEINPGNGHTNYSQKFQGRVTITVDKS ASTAYMELSSLRSEDTAVYYCARSFTTARAFAYWGQGTLVTVSSG KPGSGKPGSGKPGSGKPGSDIVMTQSPPTLSLSPGERVTLSCRAS QSISDYLHWYQQKPGQSPRLLIKYASQSISGIPARFSGSGSGTDFT LTISSLEPEDFAVYYCQDGHSFPPTFGGGTKVEIK | Fc-CD137.Bscfv |
| 489 | EPKSSDKTHTCPPCPAPEFEGGPSVFLFPPKPKDTLMISRTPEVTG VVVDVSHEDPEVKFNWYVDGVEVHNAKTKPREEQYNSTYRVVSV LTVLHQDWLNGKEYKCKVSNKALPASIEKTISKAKGQPREPQVCTL PPSRDELTKNQVSLTCLVEGFYPSDIAVEWESNGQPENNYKTTPP VLDSDGSFFLYSDLTVDKSRWQQGNVFSCSVMHEALHNHYTQES LSLSPGKSGGGSQVQLVQSGAEVKKPGASVKVSCKASGYTFSSY WMHWVRQAPGQRLEWMGEINPGNGHTNYSQKFQGRVTITVDKS ASTAYMELSSLRSEDTAVYYCARSFTTARAFAYWGQGTLVTVSSG KPGSGKPGSGKPGSGKPGSDIVMTQSPPTLSLSPGERVTLSCRAS QSISDYLHWYQQKPGQSPRLLIKYASQSISGIPARFSGSGSGTDFT LTISSLEREDFAVYYCQDGHSFPPTFGGGTKVEIKSGGGSQVQLV QSGAEVKKPGASVKVSCKASGYTFSSYWMHWVRQAPGQRLEW MGEINPGNGHTNYSQKFQGRVTITVDKSASTAYMELSSLRSEDTA VYYCARSFTTARAFAYWGQGTLVTVSSGKPGSGKPGSGKPGSGK PGSDIVMTQSPPTLSLSPGERVTLSCRASQSISDYLHWYQQKPGQ SPRLLIKYASQSISGIPARFSGSGSGTDFTLTISSLEPEDFAVYYCQ DGHSFPPTFGGGTKVEIK | Fc-CD137.Bscfv-CD137.Bscfv |
| 490 | EVQLVESGGGLVQPGGSLRLSCAASGFTESTYAMNWVRQAPGK GLEWVGRIRSKYNNYATYYADSVKGRFTISRDDSKNTLYLQMNSL RAEDTAVYYCVRHGNFGDSYVSWFEYWGQGTLVTVSSGGGGSG GGGSGGGGGGGSQAVVTQEPSLTVSPGGTVTLTCGSSTGAV TTSNYANWVQQKPGKSPRGLIGGTNKRAPGVPARFSGSLLQGKA ALTISGAQPEDEADYYCALWYSNHWVFGGGTKLTVLSGGGGSEV QLVESGGGLVQPGGSLRLSCAASGFTFSDYWMSWVRQARGKGL EWVADIKNDGSYTNYAPSLINRFTISRDNAKNSLYLQMNSLRAED TAVYYCARELTGTWGQGTMVTVSSGKPGSGKPGSGKPGSGKPG SDIVMTQSPDSLAVSLGERATINCKSSQSLLSSGNQKNYLAWYQQ KPGQPPKLLIYYASTRQSGVPDRFSGSGSGTDFTLTISSLQAEDVA VYYCLQYDRYPFTFGQGTKLEIKEPKSSDKTHTCPPCPAPEFEGG PSVFLFPPKPKDTLMISRTPEVTCVVVDVSHEDPEVKFNWYVDGV EVHNAKTKPREEQYNSTYRVVSVLTVLHQDWLNGKEYKCKVSNK ALPASIEKTISKAKGQPREPQVYTLPPCRKKLTKNQVSLTCLVKGF YPSDIAVEWESNGQPENNYKTTPPVLKSDGSFFLYSKLTVDKSRW QQGNVFSCSVMHEALHNHYTQKSLSLSPGK | CD3scfv-CD137.39scfv-Fc |
| 491 | EVQLVESGGGLVQRGGSLRLSCAASGFTFSTYAMNWVRQAPGK GLEWVGRIRSKYNNYATYYADSVKGRFTISRDDSKNTLYLQMNSL RAEDTAVYYCVRHGNFGDSYVSWFEYWGQGTLVTVSSGGGGSG GGGSGGGGSQAVVTQEPSLTVSPGGTVTLTCGSSTGAV TTSNYANWVQQKPGKSPRGLIGGTNKRAPGVPARFSGSLLGGKA ALTISGAQREDEADYYCALWYSNHWVFGGGTKLTVLSGGGGSQV QLVQSGAEVKKPGASVKVSCKASGYTFSSYWMHWVRQAPGQRL EWMGEINPGNGHTNYSQKFQGRVTITVDKSASTAYMELSSLRSED TAVYYCARSFTTARAFAYWGQGTLVTVSSGKPGSGKPGSGKPGS GKPGSDIVMTQSPPTLSLSPGERVTLSCRASQSISDYLHWYQQKR GQSPRLLIKYASQSISGIPARFSGSGSGTDFTLTISSLEPEDFAVYY CQDGHSFPPTFGGGTKVEIKEPKSSDKTHTCPPCPAPEFEGGPSV FLFPPKPKDTLMISRTPEVTCVVVDVSHEDPEVKENWYVDGVEVH NAKTKPREEQYNSTYRVVSVLTVLHQDWLNGKEYKCKVSNKALPA | CD3scfv-CD137.Bscfv-Fc |

TABLE 20-continued

SEQUENCES

| Seq ID | sequence | name |
|---|---|---|
| | SIEKTISKAKGQPREPQVYTLPPCRKKLTKNQVSLTCLVKGFYPSDI AVEWESNGQPENNYKTTPPVLKSDGSFFLYSKLTVDKSRWQQGN VFSCSVMHEALHNHYTQKSLSLSPGK | |
| 492 | QVQLVQSGAEVKKPGASVKVSCKASGYTFTNFGITWVRQAPGQG LEWMGBYPSSGNTFYNEKFKGRVTMTTDTSTSTAYMELRSLRSD DTAVYYCARGGGPLRSRYFDYWGQGTLVTVSSGGGGSGGGGSG GGGSGGGGSDIVMTQSPDSLAVSLGERATINCRSSQSLFSSGNQ KNYLTWYQQKPGQPPKLLIYWASTRESGVPDRFSGSGSGTDFTLT ISSLQAEDVAVYYCQNDYYYPLTFGGGTKVEIKSGGGGSEVQLVE SGGGLVQPGGSLRLSCAASGFTFSTYAMNWVRQAPGKGLEWVG RIRSKYNNYATYYADSVKGRFTISRDDSKNTLYLQMNSLRAEDTAV YYCVRHGNFGDSYVSWFEYWGQGTLVTVSSGKPGSGKPGSGKP GSGKPGSQAVVTQEPSLTVSPGGTVTLTCGSSTGAVTTSNYANW VQQKPGKSPRGLIGGTNKRAPGVPARFSGSLLGGKAALTISGAQR EDEADYYCALWYSNHWVFGGGTKLTVLEPKSSDKTHTCPPCPAP EFEGGPSVFLFPPKPKDTLMISRTPEVTCVVVDVSHEDPEVKFNW YVDGVEVHNAKTKPREEQYNSTYRVVSVLTVLHQDWLNGKEYKC KVSNKALPASIEKTISKAKGQPREPQVYTLPPCRKKLTKNQVSLTC LVKGFYPSDIAVEWESNGQPENNYKTTPPVLKSDGSFFLYSKLTV DKSRWQQGNVFSCSVMHEALHNHYTQKSLSLSPGK | CLDN182scfv-CD3scfv-Fc |
| 493 | QVQLVQSGAEVKKPGASVKVSCKASGYTFTNSGMNWVRQAPGQ GLEWMGWINTNTGEPTFAEEFRGRVTMTRDTSISTAYMELSRLRS DDTAVYYCARYYYGNSFAYWGQGTLVTVSSGGGGGGGGGGGG GGSGGGGSDIVMTQSPDSLAVSLGERATINCKSSQSLLNSGNQKN YLTWYQQKPGQPPKLLIYWASTRESGVPDRFSGSGSGTDFTLTIS SLQAEDVAVYYCQNNYFYPLTFGGGTKVEIKSGGGGSEVQLVESG GGLVQPGGSLRLSCAASGFTFSTYAMNWVRQAPGKGLEWVGRIR SKYNNYATYYADSVKGRFTISRDDSKNTLYLQMNSLRAEDTAVYY CVRHGNFGDSYVSWFEYWGQGTLVTVSSGKPGSGKPGSGKPGS GKPGSQAVVTQEPSLTVSPGGTVTLTCGSSTGAVTTSNYANWVQ QKPGKSPRGLIGGTNKRAPGVPARFSGSLLGGKAALTISGAQPED EADYYCALWYSNHWVFGGGTKLTVLERKSSDKTHTCPPCPAPEF EGGPSVFLFPPKPKDTLMISRTPEVTCVVVDVSHEDPEVKFNWYV DGVEVHNAKTKPREEQYNSTYRVVSVLTVLHQDWLNGKEYKCKV SNKALPASIEKTISKAKGQPREPQVYTLPPCRKKLTKNQVSLTCLV KGFYPSDIAVEWESNGQPENNYKTTPPVLKSDGSFFLYSKLTVDK SRWQQGNVFSCSVMHEALHNHYTQKSLSLSPGK | CLDN182scfv-CD3scfv-Fc |
| 494 | QVQLQQWGAGLLKPSETLSLTCAVYGGSFSGYYWSWIRQSPEKG LEWIGEINHGGYVTYNPSLESRVTISVQTSKNQFSLKLSSVTAADTA VYYCARDYGPGNYDWYFDLWGRGTLVTVSSASTKGPSVFPLARS SKSTSGGTAALGCLVKDYFPEPVTVSWNSGALTSGVHTFPAVLQS SGLYSLSSVVTVPSSSLGTQTYICNVNHKPSNTKVDKRVEPKSCD KTHTCPPCPAPEFEGGPSVFLFPPKPKDTLMISRTPEVTCVVVDVS HEDPEVKFNWYVDGVEVHNAKTKPREEQYNSTYRVVSVLTVLHQ DWLNGKEYKCKVSNKALPASIEKTISKAKGQPREPQVYTLPPCRK KLTKNQVSLTCLVKGFYPSDIAVEWESNGQPENNYKTTPPVLKSD GSFFLYSKLTVDKSRWQQGNVFSCSVMHEALHNHYTQKSLSLSP GKSGGGGSEVQLVESGGGLVQPGGSLRLSCAASGFTFSTYAMN WVRQAPGKGLEWVGRIRSKYNNYATYYADSVKGRATISRDDSKN TLYLQMNSLRAEDTAVYYCVRHGNFGDSYVSWFEYWGQGTLVTV SSGGGGSGGGGSGGGGGGGGSQAVVTQEPSLTVSPGGTVTLT CGSSTGAVTTSNYANWWQQKPGKSPRGLIGGTNKRAPGVPARFS GSLLGGKAALTISGAQPEDEADYYCALWYSNHWVFGGGTKLTVLS GGGGSQVQLVQSGAEVKKPGASVKVSCKASGYTFTDYFMNWVR QAPGQGLEWMGVINPYNDITIYNQKFQGRVTMTVDRSTSTVYMEL SSLRSEDTAVYYCAREGVLYDGYYEGAYWGQGTLVTVSSGGGGS GGGGSGGGGSDIQLTQSPSFLSASVGDRVTITCKASQNVGIAVAW YQQKPGKAPKLLIYAASNRYTGVPSRFSGSGSGTEFTLTISSLQPE DFATYYCQQYSTYPYTFGQGTKLEIK | CD137.Ufab-Fc--CD3scfv-DLL3scfv |
| 495 | QVQLVQSGAEVKKPGASVKVSCKASGYTFSSYWMHWVRQAPGQ RLEWMGEINPGNGHTNYSQKFQGRVTITVDKSASTAYMELSSLRS EDTAVYYCARSFTTARAFAYWGQGTLVTVSSASTKGPSVFPLAPS SKSTSGGTAALGCLVKDYFPEPVTVSWNSGALTSGVHTFPAVLQS SGLYSLSSVVTVPSSSIGTQTYICNVNHKPSNTKVQKRVEPKSCD KTHTCPPCPAPEFEGGPSVFLFPPKPKDTLMISRTPEVTCVVVDVS HEDPEVKENWYVDGVEVHNAKTKPREEQYNSTYRVVSVLTVLHQ DWLNGKEYKCKVSNKALPASIEKTISKAKGQPREPQVCTLPPSRD ELTKNQVSLTCLVEGFYPSDIAVEWESNGQPENNYKTTPPVLDSD GSFFLYSDLTVDKSRWQQGNVFSCSVMHEALHNHYTQESLSLSP GKSGGGGSEVQLVESGGGLVQPGGSLRLSCAASGFTESTYAMN WWRQAPGKGLEWVGRIRSKYNNYATYYADSVKGRFTISRDDSKN TLYLQMNSLRAEDTAVYYCVRHGNFGDSYVSWFEYWGQGTLVTV | CD137.Bfab-Fc-CD5scfv |

TABLE 20-continued

SEQUENCES

| Seq ID | sequence | name |
|---|---|---|
|  | SSGGGGSGGGGSGGGGSGGGGSQAVVTQEPSLTVSPGGTVTLT<br>CGSSTGAVTTSNYANWVQQKRGKSPRGLIGGTNKRAPGVPARFS<br>GSLLGGKAALTISGAQPEDEADYYCALWYSNHWVFGGGTKLTVL |  |
| 496 | QVQLVQSGAEVKKPGASVKVSCKASGYTESSYWMHWVRQAPGQ<br>RLEWMGEINPGNGHTNYSQKFQGRVTITVDKSASTAYMELSSLRS<br>EDTAVYYCARSFTTARAFAYWGQGTLVTVSSASTKGPSVFPLAPS<br>SKSTSGGTAALGCLVKDYFPEPVTVSWNSGALTSGVHTFPAVLQS<br>SGLYSLSSVVTVPSSSLGTQTYICNVNHKPSNTKVDKRVEPKSCD<br>KTHTCPPCPAPEFEGGPSVFLAPPKPKDTLMISRTPEVTCVVVDVS<br>HEDPEVKFNWYVDGVEVHNAKTKPREEQYNSTYRVVSVLTVLHQ<br>DWINGKEYKCKVSNKALPASIEKTISKAKGQPREPQVCTLPPSRD<br>ELTKNQVSLTCLVEGFYPSDIAVEWESNGQPENNYKTTPPVLQSD<br>GSFFLYSDLTVDKSRWQQGNVFSCSVMHEALHNHYTQESLSLSP<br>GKSGGGGSEVQLVESGGGLVQPGGSLRLSCAASGFTFSTYAMN<br>WRQAPGKGLEWVGRIRSKYNNYATYYADSVKGRATISRDDSKN<br>TLYLQMNSLRAEDTAVYYCVRHGNFGDSYVSWFEYWGQGTLVTV<br>SSGGGGSGGGGSGGSGGGGSQAVVTQEPSLTVSPGGTVTLT<br>CGSSTGAVTTSNYANWVQQKFGKSPRGLIGGTNKRAPGVPARFS<br>GSLLGGKAALTISGAQPEDEADYYCALWYSNHWVFGGGTKLTVLS<br>GGGGSQVQLVQSGAEVKKPGASVKVSCKASGYTFTDYFMNWVR<br>QAPGQGLEWMGVINPYNDITIYNQKFQGRVTMTVDRSTSTVYMEL<br>SSLRSEDTAVYYCAREGVLYDGYYEGAYWGQGTLVTVSSGGGGS<br>GGGGSGGGGSDIQLTQSPSFLSASVGDRVTITCKASQNVGIAVAW<br>YQQKPGKAPKLLIYAASNRYTGVPSRFSGSGSTEFTLTISSLQPE<br>DFATYYCQQYSTYPYTFGQGTKLEIK | CD137.Bfab-<br>Fc--<br>CD3scfv-<br>DLL3scfv |
| 497 | QVQLVQSGAEVKKPGASVKVSCKASGYTFTDYFMNWVRQAPGQ<br>GLEWMGVINPYNDITIYNQKFQGRVTMTVQRSTSTVYMELSSLRS<br>EDTAVYYCAREGVLYDGYYEGAYWGQGTLVTVSSGGGGGGGG<br>SGGGGSDIQLTQSPSFLSASVGDRVTITCKASQNVGIAVAWYQQK<br>PGKAPKLLYAASNRYTGVPSRFSGSGSTEFTLTISSLQPEDFAT<br>YYCQQYSTYPYTFGQGTKLEIKSGGGSEVQLVESGGGLVQPGGS<br>LRLSCAASGFTFSTYAMNWVRQAPGKGLEWVGRIRSKYNNYATY<br>YADSVKGRFTISRDDSKNTLYLQMNSLRAEDTAVYYCVRHGNFGD<br>SYVSWFEYWGQGTLVTVSSGKPGSGKPGSGKPGSGKPGSQAVV<br>TQEPSLTVSPGGTVTLTCGSSTGAVTTSNYANWVQQKPGKSPRG<br>LIGGTNKRAPGVPARFSGSLLGGKAALTISGAQPEDEADYYCALW<br>YSNHWVFGGGTKLTVLEPKSSDKTHTCPPCPAPEFEGGPSVFLAP<br>PKPKDTLMISRTPEVTCVVVDVSHEDPEVKFNWYVDGVEVHNAKT<br>KPREEQYNSTYRVVSVLIVLHQDWLNGKEYKCKVSNKALPASIEK<br>TISKAKGQPREPQVYTLPPCRKKLTKNQVSLTCLVKGFYPSDIAVE<br>WESNGQPENNYKTTPPVLKSDGSFFLYSKLTVDKSRWQQGNVFS<br>CSVMNEALNNHYTQKSLSLSPGKSGGGSQVQLVQSGAEVKKPGA<br>SVKVSCKASGYTFSSYWMHWVRQAPGQRLEWMGEINPGNGHTN<br>YSQKFQGRVTITVDKSASTAYMELSSLRSEDTAVYYCARSFTTARA<br>FAYWGQGTLVTVSSGKPGSGKPGSGKPGSGKPGSDIVMTQSPPT<br>LSLSPGERVTLSCRASQSISDYLHWYQQKPGQSPRLLIKYASQSIS<br>GIPARFSGSGSGTDFTLTISSLEPEDFAVYYCQDGHSFPPTFGGGT<br>KVEIK | DLL3scfv-<br>CD3scfv-<br>Fc-<br>CD137.Bscfv |
| 498 | QVQLVQSGAEVKKPGASVKVSCKASGYTFTDYFMNWVRQAPGQ<br>GLEWMGVINPYNDITIYNQKFQGRVTMTVDRSTSTVYMELSSLRS<br>EDTAVYYCAREGVLYDGYYEGAYWGQGTLVTVSSASTKGPSVFP<br>LAPSSKSTSGGTAALGCLVKDYFPEPVTVSWNSGALTSGVHTFPA<br>VLQSSGLYSLSSVVTVPSSSLGTQTYICNVNHKPSNTKVDKRVEPK<br>SCDKTHTCPPCPAPEFEGGPSVFLFPPKPKDTLMISRTPEVTCVVV<br>DVSHEDPEVKFNWYVDGVEVHNAKTKPREEQYNSTYRVVSVLTV<br>LHQDWLNGKEYKCKVSNKALPASIEKTISKAKGQPREPQVCTLPP<br>SRDELTKNQVSLTCLVEGFYPSDIAVEWESNGQPENNYKTTPPVL<br>DSDGSFFLYSDLTVDKSRWQQGNVFSCSVMHEALHNHYTQESLS<br>LSPGKSGGGSQVQLVQSGAEVKKPGASVKVSCKASGYTFSSYW<br>MHWWRQAPGQRLEWMIGEINPGNGHTNYSQKFQGRVTITVDKSÅ<br>STAYMELSSLRSEDTAVYYCARSFTTARAFAYWGQGTLVTVSSGK<br>PGSGKPGSGKFGSGKPGSDIVMTQSPPTLSLSPGERVTLSCRAS<br>QSISDYLHWYQQKPGQSPRLLIKYASQSISGIPARFSGSGSGTDFT<br>LTISSLEPEDFAVYYCQDGHSFPPTFGGGTKVEIK | DLL3Fab-<br>Fc-<br>CD137.Bscfv |
| 499 | QVQLVQSGAEVKKPGASVKVSCKASGYTFTDYFMNWRQAPGQ<br>GLEWMGVINPYNDITIYNQKFQGRVTMTVDRSTSTVYMELSSLRS<br>EDTAVYYCAREGVLYDGYYEGAYWGQGTLVTVSSASTKGPSVFP<br>LARSSKSTSGGTAALGCLVKDYFREPVTVSWNSGALTSGVHTFRA<br>VLQSSGLYSLSSVVTVPSSSLGTQTYICNVNHKPSNTKVDKRVEPK<br>SCDKTHTCPPCPAPEFEGGPSVFLFPPKPKDTLMISRTPEVTCVVV<br>DVSHEDPEVKFNWYVDGVEVHNAKTKPREEQYNSTYRVVSVLTV<br>LHQDWLNGKEYKCKVSNKALPASIEKTISKAKGQPREPQVCTLPP | DLL3Fab-<br>Fc-<br>CD137.Bscfv-<br>CD137.Bscfv |

TABLE 20-continued

| Seq ID | sequence | name |
|---|---|---|
| | SRDELTKNQVSLTCLVEGFYPSDIAVEWESNGQPENNYKTTPPVL<br>DSDGSFFLYSDLTVDKSRWQQGNVFSCSVMHEALHNHYTQESLS<br>LSPGKSGGGSQVQLVQSGAEVKKPGASVKVSCKASGYTFSSYW<br>MHWVRQAPGQRLEWMGEINPGNGHTNYSQKFQGRVTITVDKSA<br>STAYMELSSLRSEDTAVYYCARSFTTARAFAYWGQGTLVTVSSGK<br>PGSGKPGSGKPGSGKPGSDIVMTQSPPTLSLSPGERVTLSCRAS<br>QSISDYLHWYQQKPGQSPRLLIKYASQSISGIPARFSGSGSGTDFT<br>LTISSLEPEDFAVYYCQDGHSFPPTFGGGTKVEIKSGGGSQVQLV<br>QSGAEVKKPGASVKVSCKASGYTFSSYWMHWRQAPGQRLEW<br>MGEINPGNGHTNYSQKFQGRVTITVDKSASTAYMELSSLRSEDTA<br>VYYCARSFTTARAFAYWGQGTLVTVSSGKPGSGKPGSGKPGSGK<br>PGSDIVMTQSPPTLSLSPGERVTLSCRASQSISDYLHWYQQKPGQ<br>SPRLLIKYASQSISGIPARFSGSGSGTDFTLTISSLEPEDFAVYYCQ<br>DGHSFPPTFGGGTKVEIK | |
| 500 | QVQLVQSGAEVKKPGASVKVSCKASGYTFTSYYINWVRQAPGQG<br>LEWIGSIYPGNVNTNYNEKFKDRATLTVDTSISTAYMELSRLRSDD<br>TAVYFCTRSHYGLDWNFDVWGQGTTVTVSSGGGGSGGGGSGG<br>GGSGGGGSDIQMTQSPSSLSASVGDRVTITCHASQNIYVWLNWY<br>QQKPGKAPKLLIYKASNLHTGVPSRFSGSGSGTDFTLTISSLQPED<br>FATYYCQQGQTYPYTFGGGTKVEIKSGGGGSQVQLVQSGAEVKK<br>PGASVKVSCKASGYTFSSYWMHWRQAPGQRLEWMGEINPGNG<br>HTNYSQKFQGRVTITVQKSASTAYMELSSLRSEDTAVYYCARSFTT<br>ARAFAYWGQGTLVTVSSGKPGSGKPGSGKPGSGKPGSDIVMTQS<br>PPTLSLSPGERVTLSCRASQSISDYLHWYQQKPGQSPRLLIKYASQ<br>SISGIPARFSGSGSGTDFTLTISSLEPEDFAVYYCQDGHSFPPTFG<br>GGTKVEIKEPKSSDKTHTCPPCPAPEFEGGPSVFLFPPKPKDTLMI<br>SRTPEVTCVVVDVSHEDPEVKFNWYVDGVEVHNAKTKPREEQYN<br>STYRVVSVLTVLHQDWLNGKEYKCKVSNKALPASIEKTISKAKGQP<br>REPQVYTLPPCRKKLTKNQVSLTCLVKGFYPSDIAVEWESNGQPE<br>NNYKTTPPVLKSDGSFFLYSKLTVDKSRWQQGNVFSCSVMHEAL<br>HNHYTQKSLSLSPGK | CD28(C50S)<br>scfv-<br>CD137.Bscfv-<br>Fc |
| 501 | QVQLVQSGAEVKKPGASVKVSCKASGYTFTSYYINWVRQAPGQG<br>LEWIGSIYPGNVNTNYNEKFKDRATLTVDTSISTAYMELSRLRSDD<br>TAVYFCTRSHYGLDWNFDVWGQGTTVTVSSGGGGSGGGGSGG<br>GGSGGGGSDIQMTQSPSSLSASVGDRVTITCHASQNIYVWLNWY<br>QQKPGKAPKLLIYKASNLHTGVPSRFSGSGSGTDFTLTISSLQPED<br>FATYYCQQGQTYPYTFGGGTKVEIKSGGGGSEVQLVESGGGLVQ<br>PGGSLRLSCAASGFTFSDYWMSWVRQAPGKGLEWVADIKNDGS<br>YTNYAPSLTNRFTISRDNAKNSLYLQMNSLRAEDTAVYYCARELTG<br>TWGQGTMVTVSSGKPGSGKPGSGKPGSGKPGSDIVMTQSPDSL<br>AVSLGERATINCKSSQSLLSSGNQKNYLAWYQQKRGQPPKLLIYY<br>ASTRQSGVPDRFSGSGSGTDFTLTISSLQAEDVAVYYCLQYDRYP<br>FTFGQGTKLEIKEPKSSDKTHTCPPCPAPEFEGGPSVFLFPPKPKD<br>TLMISRTPEVTCVVVDVSHEDPEVKFNWYVDGVEVHNAKTKPREE<br>QYNSTYRVVSVLTVLHQDWLNGKEYKCKVSNKALPASIEKTISKAK<br>GQPREPQVYTLPPCRKKLTKNQVSLTCLVKGFYPSDIAVEWESNG<br>QPENNYKTTPPVLKSDGSFFLYSKLTVDKSRWQQGNVFSCSVMH<br>EALHNHYTQKSLSLSPGK | CD28(C50S)<br>scfv-<br>CD137.39scfv-<br>Fc |
| 502 | QVQLVQSGAEVKKPGASVKVSCKASGYTFSSYWMHWVRQAPGQ<br>RLEWMGEINPGNGHTNYSQKFQGRVTITVDKSASTAYMELSSLRS<br>EDTAVYYCARSFTTARAFAYWGQGTLVTVSSGGGGSGGGGSGG<br>GGSGGGGSDIVMTQSPPTLSLSPGERVTLSCRASQSISDYLHWYQ<br>QKPGQSPRLLIKYASQSISGIPARFSGSGSGTDFTLTISSLEPEDFA<br>VYYCQDGHSFPPTFGGGTKVEIKSGGGGSQVQLVQSGAEVKKPG<br>ASVKVSCKASGYTFTSYYIHWVRQAPGQGLEWIGSIYPGNVNTNY<br>NEKFKDRATLTVDTSISTAYMELSRLRSDDTAVYFCTRSHYGLDW<br>NFDVWGQGTTVTVSSGKPGSGKPGSGKPGSGKPGSDIQMTQSP<br>SSLSASVGDRVTITCHASQNIYVWLNWYQQKPGKAPKLLYKASNL<br>HTGVPSRFSGSGSGTDFTLTISSLQPEDFATYYCQQGQTYPYTFG<br>GGTKVEIKEPKSSDKTHTCPPCPAPEFEGGPSVFLFPPKPKDTLMI<br>SRTPEVTCVVVDVSHEDPEVKFNWYVDGVEVHNAKTKPREEQYN<br>STYRVVSVLTVLHQDWLNGKEYKCKVSNKALPASIEKTISKAKGQP<br>REPQVYTLPPCRKKLTKNQVSLTCLVKGFYPSDIAVEWESNGQPE<br>NNYKTTPPVLKSDGSFFLYSKLTVDKSRWQQGNVFSCSVMHEAL<br>HNHYTQKSLSLSPGK | CD137.Bscfv-<br>CD28(C50S)<br>scfv-Fc |
| 503 | EVQLVESGGGLVQPGGSLRLSCAASGFTFSDYWMSWVRQAPGK<br>GLEWVADIKNDGSYTNYAPSLTNRFTISRDNAKNSLYLQMNSLRA<br>EDTAVYYCARELTGTWGQGTMVTVSSGGGGSGGGGSGGGGSG<br>GGGSDIVMTQSPDSLAVSLGERATINCKSSQSLLSSGNQKNYLAW<br>YQQKPGQPPKLLIYYASTRQSGVPDRFSGSGSGTDFTLTISSLQAE<br>DVAVYYCLQYDRYPFTFGQGTKLEIKSGGGGSQVQLVQSGAEVK<br>KPGASVKVSCKASGYTFTSYYINWVRQAPGQGLEWIGSIYPGNVN | CD137.39scfv-<br>CD28(C50S)<br>scfv-Fc |

TABLE 20-continued

SEQUENCES

| Seq ID | sequence | name |
|---|---|---|
| | TNYNEKFKDRATLTVDTSISTAYMELSRLRSDDTAVYFCTRSHYGL DWNFDVWGQGTTVTVSSGKPGSGKPGSGKPGSGKFGSDIQMTQ SPSSLSASVGDRVTITCHASQNIYVWLNWYQQKPGKAPKLLIYKAS NLHTGVPSRFSGSGSGTDFTLTISSLQPEDFATYYCQQGQTYPYT FGGGTKVEIKEPKSSDKTHTCPPCPAPEFEGGPSVFLFPPKPKDTL MISRTPEVTGVVVDVSHEDPEVKFNWYVDGVEVHNAKTKPREEQ YNSTYRVVSVLTVLHQDWLNGKEYKCKVSNKALPASIEKTISKAKG QPREPQVYTLPPCRKKLTKNQVSLTCLVKGFYPSDIAVEWESNGQ PENNYKTTPPVLKSDGSFFLYSKLTVDKSRWQQGNVFSCSVMHE ALHNHYTQKSLSLSPGK | |

SEQUENCE LISTING (509 sequences)

SEQ ID NO: 1 - protein, 10 aa, Artificial Sequence
  Description of Artificial Sequence: Synthetic peptide
DYIFSNYYIE

SEQ ID NO: 2 - protein, 10 aa, Artificial Sequence
  Description of Artificial Sequence: Synthetic peptide
DYTFSNYYIE

SEQ ID NO: 3 - protein, 5 aa, Artificial Sequence
  Description of Artificial Sequence: Synthetic peptide
DYYMN

SEQ ID NO: 4 - protein, 5 aa, Artificial Sequence
  Description of Artificial Sequence: Synthetic peptide
DYYVN

SEQ ID NO: 5 - protein, 10 aa, Artificial Sequence
  Description of Artificial Sequence: Synthetic peptide
GFTFSNYGMH

SEQ ID NO: 6 - protein, 10 aa, Artificial Sequence
  Description of Artificial Sequence: Synthetic peptide
GFTFSSYGMH

SEQ ID NO: 7 - protein, 10 aa, Artificial Sequence
  Description of Artificial Sequence: Synthetic peptide
GFTFSSYGMH

SEQ ID NO: 8 - protein, 6 aa, Artificial Sequence
  Description of Artificial Sequence: Synthetic peptide
SAYYWN

SEQ ID NO: 9 - protein, 5 aa, Artificial Sequence
  Description of Artificial Sequence: Synthetic peptide
SYYWS

SEQ ID NO: 10 - protein, 17 aa, Artificial Sequence
  Description of Artificial Sequence: Synthetic peptide
EILPGNGNTVYNEKFKD

SEQ ID NO: 11 - protein, 17 aa, Artificial Sequence
  Description of Artificial Sequence: Synthetic peptide
EILPGTGNTVYNEKFKD

SEQ ID NO: 12 - protein, 17 aa, Artificial Sequence
  Description of Artificial Sequence: Synthetic peptide
IISPNDGGTNYNQKFKG

SEQ ID NO: 13 - protein, 17 aa, Artificial Sequence
  Description of Artificial Sequence: Synthetic peptide
VINPDNGITTYNQKFKG

SEQ ID NO: 14 - protein, 17 aa, Artificial Sequence
  Description of Artificial Sequence: Synthetic peptide
VINPYNDITIYNQKFQG

SEQ ID NO: 15 - protein, 17 aa, Artificial Sequence
  Description of Artificial Sequence: Synthetic peptide
VISGSGSSKYYADSVKG

SEQ ID NO: 16 - protein, 17 aa, Artificial Sequence
  Description of Artificial Sequence: Synthetic peptide
VISHHGSSKYYADSVKG

SEQ ID NO: 17 - protein, 17 aa, Artificial Sequence
  Description of Artificial Sequence: Synthetic peptide
VISHHGSSKYYARSVKG

SEQ ID NO: 18 - protein, 17 aa, Artificial Sequence
  Description of Artificial Sequence: Synthetic peptide
VISYDGSSKYYADSVKG

SEQ ID NO: 19 - protein, 16 aa, Artificial Sequence
  Description of Artificial Sequence: Synthetic peptide
YISDVGHNYYNPSLKN

SEQ ID NO: 20 - protein, 16 aa, Artificial Sequence
  Description of Artificial Sequence: Synthetic peptide
YISDVGSNNYNPSLKN

SEQ ID NO: 21 - protein, 16 aa, Artificial Sequence
  Description of Artificial Sequence: Synthetic peptide
YVYYSGTTNYNPSLKS

SEQ ID NO: 22 - protein, 9 aa, Artificial Sequence
  Description of Artificial Sequence: Synthetic peptide
WGDYALFAN

SEQ ID NO: 23 - protein, 6 aa, Artificial Sequence
  Description of Artificial Sequence: Synthetic peptide
DQVFAY

SEQ ID NO: 24 - protein, 9 aa, Artificial Sequence
  Description of Artificial Sequence: Synthetic peptide
DWFFYLFDY

SEQ ID NO: 25 - protein, 9 aa, Artificial Sequence
  Description of Artificial Sequence: Synthetic peptide
DWFYFIFDY

SEQ ID NO: 26 - protein, 9 aa, Artificial Sequence
  Description of Artificial Sequence: Synthetic peptide
DWWELVFDY

SEQ ID NO: 27 - protein, 13 aa, Artificial Sequence
  Description of Artificial Sequence: Synthetic peptide
EGVLYDGYYEGAY

SEQ ID NO: 28 - protein, 11 aa, Artificial Sequence
  Description of Artificial Sequence: Synthetic peptide
GVWNYERSFDY

SEQ ID NO: 29 - protein, 11 aa, Artificial Sequence
  Description of Artificial Sequence: Synthetic peptide
SIAVTGFYFDY

SEQ ID NO: 30 - protein, 10 aa, Artificial Sequence
  Description of Artificial Sequence: Synthetic peptide
SASSSVSYMH

SEQ ID NO: 31 - protein, 11 aa, Artificial Sequence
  Description of Artificial Sequence: Synthetic peptide
KASQNVGIAVA

SEQ ID NO: 32 - protein, 11 aa, Artificial Sequence
  Description of Artificial Sequence: Synthetic peptide
KASQNVGTNVA

SEQ ID NO: 33 - protein, 16 aa, Artificial Sequence
  Description of Artificial Sequence: Synthetic peptide
KSSQSLLHSDAKTFLY

SEQ ID NO: 34 - protein, 16 aa, Artificial Sequence
  Description of Artificial Sequence: Synthetic peptide
KSSQSLLHSDGKTFLY

SEQ ID NO: 35 - protein, 15 aa, Artificial Sequence
  Description of Artificial Sequence: Synthetic peptide
RASESVHSYGNSLIH

SEQ ID NO: 36 - protein, 16 aa, Artificial Sequence
  Description of Artificial Sequence: Synthetic peptide
RSSKSLLHSNGITYLY

SEQ ID NO: 37 - protein, 16 aa, Artificial Sequence
  Description of Artificial Sequence: Synthetic peptide
RSSQSLLHSDAKTFLD

SEQ ID NO: 38 - protein, 16 aa, Artificial Sequence
  Description of Artificial Sequence: Synthetic peptide
RSSQSLLHSDGKTFLD

SEQ ID NO: 39 - protein, 7 aa, Artificial Sequence
  Description of Artificial Sequence: Synthetic peptide
SASYRYS

SEQ ID NO: 40 - protein, 7 aa, Artificial Sequence
  Description of Artificial Sequence: Synthetic peptide
AASNRYT

SEQ ID NO: 41 - protein, 7 aa, Artificial Sequence
  Description of Artificial Sequence: Synthetic peptide
DTSKLAS

SEQ ID NO: 42 - protein, 7 aa, Artificial Sequence
  Description of Artificial Sequence: Synthetic peptide
EVSNRAS

SEQ ID NO: 43 - protein, 7 aa, Artificial Sequence
  Description of Artificial Sequence: Synthetic peptide
EVSNRFS

SEQ ID NO: 44 - protein, 7 aa, Artificial Sequence
  Description of Artificial Sequence: Synthetic peptide
QMSNLAS

SEQ ID NO: 45 - protein, 7 aa, Artificial Sequence
  Description of Artificial Sequence: Synthetic peptide
RASNLES

SEQ ID NO: 46 - protein, 7 aa, Artificial Sequence
  Description of Artificial Sequence: Synthetic peptide
SASYRYS

SEQ ID NO: 47 - protein, 9 aa, Artificial Sequence
  Description of Artificial Sequence: Synthetic peptide
QQYSTYPYT

SEQ ID NO: 48 - protein, 7 aa, Artificial Sequence
  Description of Artificial Sequence: Synthetic peptide
AQNLELP

SEQ ID NO: 49 - protein, 9 aa, Artificial Sequence
  Description of Artificial Sequence: Synthetic peptide
LQGERLPFT

SEQ ID NO: 50 - protein, 9 aa, Artificial Sequence
  Description of Artificial Sequence: Synthetic peptide
LQGIHLPFT

SEQ ID NO: 51 - protein, 9 aa, Artificial Sequence
  Description of Artificial Sequence: Synthetic peptide
LQGRELPFT

SEQ ID NO: 52 - protein, 7 aa, Artificial Sequence
  Description of Artificial Sequence: Synthetic peptide
QQTNEDP

SEQ ID NO: 53 - protein, 9 aa, Artificial Sequence
  Description of Artificial Sequence: Synthetic peptide
QQWSSNPLT

SEQ ID NO: 54 - protein, 9 aa, Artificial Sequence
  Description of Artificial Sequence: Synthetic peptide
QQYNNYPLT

SEQ ID NO: 55 - protein, 9 aa, Artificial Sequence
  Description of Artificial Sequence: Synthetic peptide
QQYNSYPFT

SEQ ID NO: 56 - protein, 118 aa, Artificial Sequence
  Description of Artificial Sequence: Synthetic polypeptide
EVQLLESGGGLVQPGGSLRLSCAASGFTFSSYGMHWVRQAPGKGLEWVAVISGSGSSKYYADSVKGRFTISRDNSKNTLYLQMNSLRAEDTAVYYCARDWFFYLFDYWGQGTLVTVSS

SEQ ID NO: 57 - protein, 118 aa, Artificial Sequence
  Description of Artificial Sequence: Synthetic polypeptide
EVQLLESGGGLVQPGGSLRLSCAASGFTFSSYGMHWVRQAPGKGLEWVAVISGSGSSKYYADSVKGRFTISRDNSKNTLYLQMNSLRAEDTAVYYCARDWFYFIFDYWGQGTLVTVSS

SEQ ID NO: 58 - protein, 118 aa, Artificial Sequence
  Description of Artificial Sequence: Synthetic polypeptide
EVQLLESGGGLVQPGGSLRLSCAASGFTFSSYGMHWVRQAPGKGLEWVAVISHHGSSKYYADSVKGRFTISRDNSKNTLYLQMNSLRAEDTAVYYCARDWFFYLFDYWGQGTLVTVSS

SEQ ID NO: 59 - protein, 118 aa, Artificial Sequence
  Description of Artificial Sequence: Synthetic polypeptide
EVQLLESGGGLVQPGGSLRLSCAASGFTFSSYGMHWVRQAPGKGLEWVAVISHHGSSKYYADSVKGRFTISRDNSKNTLYLQMNSLRAEDTAVYYCARDWFYFIFDYWGQGTLVTVSS

SEQ ID NO: 60 - protein, 118 aa, Artificial Sequence
  Description of Artificial Sequence: Synthetic polypeptide
EVQLLESGGGLVQPGGSLRLSCAASGFTFSSYGMHWVRQAPGKGLEWVAVISYDGSSKYYADSVKGRFTISRDNSKNTLYLQMNSLRAEDTAVYYCARDWFFYLFDYWGQGTLVTVSS

SEQ ID NO: 61 - protein, 118 aa, Artificial Sequence
  Description of Artificial Sequence: Synthetic polypeptide
EVQLLESGGGLVQPGGSLRLSCAASGFTFSSYGMHWVRQAPGKGLEWVAVISYDGSSKYYADSVKGRFTISRDNSKNTLYLQMNSLRAEDTAVYYCARDWFYFIFDYWGQGTLVTVSS

SEQ ID NO: 62 - protein, 118 aa, Artificial Sequence
  Description of Artificial Sequence: Synthetic polypeptide
EVQLLESGGGLVQPGGSLRLSCAASGFTFSSYGMHWVRQAPGKGLEWVSVISHHGSSKYYADSVKGRFTISRDNSKNTLYLQMNSLRAEDTAVYYCAKDWFFYLFDYWGQGTLVTVSS

SEQ ID NO: 63 - protein, 118 aa, Artificial Sequence
  Description of Artificial Sequence: Synthetic polypeptide
EVQLLESGGGLVQPGGSLRLSCAASGFTFSSYGMHWVRQAPGKGLEWVSVISHHGSSKYYADSVKGRFTISRDNSKNTLYLQMNSLRAEDTAVYYCAKDWFYFIFDYWGQGTLVTVSS

SEQ ID NO: 64 - protein, 120 aa, Artificial Sequence
  Description of Artificial Sequence: Synthetic polypeptide
EVQLQQSGPVLVKPGASVKMSCKASGFTFTDYYMNWVKQSHGKSLEWIGVINPDNGITTYNQKFKGKATLTVDKSSSTAYMELNGLTSEDSAVYYCARGVWNYERSFDYWGQGTTLTVSS

SEQ ID NO: 65 - protein, 118 aa, Artificial Sequence
  Description of Artificial Sequence: Synthetic polypeptide
EVQLVESGGGLVQPGGSLRLSCAASGFTFSNYGMHWVRQAPGKGLEWVAVISHHGSSKYYADSVKGRYTISRDNSKNTLYLQMNSLRAEDTAVYYCARDWFFYLFDYWGQGTLVTVSS

SEQ ID NO: 66 - protein, 118 aa, Artificial Sequence
  Description of Artificial Sequence: Synthetic polypeptide
QVQLQESGPGLVKPSETLSLTCTVSGGSISSYYWSWIRQPPGKGLEWIGYVYYSGTTNYNPSLKSRVTISVDTSKNQFSLKLSSVTAADTAVYYCASIAVTGFYFDYWGQGTLVTVSS

SEQ ID NO: 67 - protein, 119 aa, Artificial Sequence
  Description of Artificial Sequence: Synthetic polypeptide
QVQLQQSGPVLVKPGASVKMSCKASGYSFTDYYVNWVKQSHGKSLEWIGIISPNDGGTNYNQKFKGKATLTVDKSSSTAYMEVNSLTSEDSAVYYCARDDDLGWYFDVWGTGTTVTVSS

SEQ ID NO: 68 - protein, 118 aa, Artificial Sequence
  Description of Artificial Sequence: Synthetic polypeptide
QVQLVESGGGAVQPGRSLRLSCAASGFTFSNYGMHWVRQAPGKGLEWVAVISHHGSSKYYARSVKGRFTISRDNSKNTLYLEMNSLRAEDTAVYYCARDWWELVFDYWGQGTLVTVSS

SEQ ID NO: 69 - protein, 118 aa, Artificial Sequence
  Description of Artificial Sequence: Synthetic polypeptide
QVQLVESGGGVVQPGRSLRLSCAASGFTFSNYGMHWVRQAPGKGLEWVAVISHHGSSKYYADSVKGRFTISRDNSKNTLYLQMNSLRAEDTAVYYCARDWFFYLFDYWGQGTLVTVSS

SEQ ID NO: 70 - protein, 118 aa, Artificial Sequence
  Description of Artificial Sequence: Synthetic polypeptide
QVQLVESGGGVVQPGRSLRLSCAASGFTFSNYGMHWVRQAPGKGLEWVAVISHHGSSKYYADSVKGRFTISRDNSKNTLYLQMNSLRAEDTAVYYCARDWFYFIFDYWGQGTLVTVSS

SEQ ID NO: 71 - protein, 118 aa, Artificial Sequence
  Description of Artificial Sequence: Synthetic polypeptide
QVQLVQSGAEVKKPGASVKVSCKASDYTFSNYYIEWVRQAPGQGLEWMGEILPGNGNTVYNEKFKDRVTMTVDTSTSTAYMELRSLRSDDTAVYYCARWGDYALFANWGQGTLVTVSS

SEQ ID NO: 72 - protein, 122 aa, Artificial Sequence
  Description of Artificial Sequence: Synthetic polypeptide
QVQLVQSGAEVKKPGASVKVSCKASGYTFTDYFMNWVRQAPGQGLEWMGVINPYNDITIYNQKFQGRVTMTVDRSTSTVYMELSSLRSEDTAVYYCAREGVLYDGYYEGAYWGQGTLVTVSS

SEQ ID NO: 73 - protein, 118 aa, Artificial Sequence
  Description of Artificial Sequence: Synthetic polypeptide
QVQLVQSGAEVKKPGASVKVSCKATDYIFSNYYIEWVRQAPGQGLEWMGEILPGTGNTVYNEKFKDRVTMTVDTSTSTVYMELSSLRSEDTAVYYCARWGDYALFANWGQGTLVTVSS

SEQ ID NO: 74 - protein, 116 aa, Artificial Sequence
  Description of Artificial Sequence: Synthetic polypeptide
SDVQLQESGPGLVKPSQSLSLTCSVTGYSITSAYYWNWIRQFPGNKLEWMGYISDVGHNYYNPSLKNRISITRDTSKNQFFLKLNSVTPEDTATYYCARDQVFAYWGQGTLVTVSA

SEQ ID NO: 75 - protein, 115 aa, Artificial Sequence
  Description of Artificial Sequence: Synthetic polypeptide
SDVQLQESGPGLVKPSQSLSLTCSVTGYSITSAYYWNWIRQFPGNKLEWMGYISDVGSNNYNPSLKNRISITRDTFKNQFFLKLNSVTTEDTATYFCTRDQVFAYWGQGTLVTVS

SEQ ID NO: 76 - protein, 107 aa, Artificial Sequence
  Description of Artificial Sequence: Synthetic polypeptide
DIQLTQSPSFLSASVGDRVTITCKASQNVGIAVAWYQQKPGKAPKLLIYAASNRYTGVPSRFSGSGSGTEFTLTISSLQPEDFATYYCQQYSTYPYTFGQGTKLEIK

SEQ ID NO: 77 - protein, 107 aa, Artificial Sequence
  Description of Artificial Sequence: Synthetic polypeptide
DIQMTQSPSFLSASVGDRVTITCKASQNVGTNVAWYQQKPGKAPKPLIYSTSYRYSGVPSRFSGSGSGTEFTLTISSLQPEDFATYYCQQYNNYPLTFGGGTKVEIK

SEQ ID NO: 78 - protein, 112 aa, Artificial Sequence
  Description of Artificial Sequence: Synthetic polypeptide
DIQMTQSPSSLSASVGDRVTITCKSSQSLLHSDAKTFLYWYQQKPGKAPKLLIYEVSNRFSGVPSRFSGSGSGTDFTLTISSLQPEDFATYYCLQGERLPFTFGQGTKVEIK

SEQ ID NO: 79 - protein, 107 aa, Artificial Sequence
  Description of Artificial Sequence: Synthetic polypeptide
DIQMTQSPSTLSASVGDRVTITCKASQNVGTNVAWYQQKPGKAPKALIYSASYRYSGVPSRFSGSGSGTEFTLTISSLQPDDFATYYCQQYNSYPFTFGQGTKLEIK

SEQ ID NO: 80 - protein, 112 aa, Artificial Sequence
  Description of Artificial Sequence: Synthetic polypeptide
DIVMTQAAFSNPVTVGTSASISCRSSKSLLHSNGITYLYWYLQKPGQSPQLLIYQMSNLASGVPDRFSSSGSGTDFTLRISRVEAEDVGVYYCAQNLELPWTFGGGTKLEIK

SEQ ID NO: 81 - protein, 107 aa, Artificial Sequence
  Description of Artificial Sequence: Synthetic polypeptide
DIVMTQSPKFMSTSVGDRVSVTCKASQNVGTNVAWYQQKPGQSPKALIYSASYRYSGVPDRFTGSGSGTDFTLTFSSVQSEDLAEYFCQQYNNYPLTFGGGTKLEIK

SEQ ID NO: 82 - protein, 112 aa, Artificial Sequence
  Description of Artificial Sequence: Synthetic polypeptide
DIVMTQSPLSLPVTPGEPASISCKSSQSLLHSDAKTFLYWYLQKPGQSPQLLIYEVSNRFSGVPDRFSGSGSGTDFTLKISRVEAEDVGVYYCLQGRELPFTFGQGTKVEIK

SEQ ID NO: 83 - protein, 112 aa, Artificial Sequence
  Description of Artificial Sequence: Synthetic polypeptide
DIVMTQSPLSLPVTPGEPASISCKSSQSLLHSDGKTFLYWYLQKPGQSPQLLIYEVSNRFSGVPDRFSGSGSGTDFTLKISRVEAEDVGVYYCLQGERLPFTFGQGTKVEIK

SEQ ID NO: 84 - protein, 112 aa, Artificial Sequence
  Description of Artificial Sequence: Synthetic polypeptide
DIVMTQSPLSLPVTPGEPASISCRSSQSLLHSDAKTFLDWYLQKPGQSPQLLIYEVSNRASGVPDRFSGSGSGTDFTLKISRVEAEDVGVYYCLQGRELPFTFGQGTKVEIK

SEQ ID NO: 85 - protein, 112 aa, Artificial Sequence
  Description of Artificial Sequence: Synthetic polypeptide
DIVMTQSPLSLPVTPGEPASISCRSSQSLLHSDGKTFLDWYLQKPGQSPQLLIYEVSNRASGVPDRFSGSGSGTDFTLKISRVEAEDVGVYYCLQGERLPFTFGQGTKVEIK

SEQ ID NO: 86 - protein, 112 aa, Artificial Sequence
  Description of Artificial Sequence: Synthetic polypeptide
DIVMTQTPLSLSVTPGQPASISCKSSQSLLHSDAKTFLYWYLQKPGQPPQLLIYEVSNRFSGVPDRFSGSGSGTDFTLKISRVEAEDVGVYYCLQGRELPFTFGPGTKVEIK

SEQ ID NO: 87 - protein, 112 aa, Artificial Sequence
  Description of Artificial Sequence: Synthetic polypeptide
DIVMTQTPLSLSVTPGQPASISCKSSQSLLHSDGKTFLYWYLQKPGQPPQLLIYEVSNRFSGVPDRFSGSGSGTDFTLKISRVEAEDVGVYYCLQGERLPFTFGPGTKVEIK

SEQ ID NO: 88 - protein, 112 aa, Artificial Sequence
  Description of Artificial Sequence: Synthetic polypeptide
DIVMTQTPLSLSVTPGQPASISCKSSQSLLHSDGKTFLYWYLQKPGQPPQLLIYEVSNRFSGVPDRFSGSGSGTDFTLKISRVEAEDVGVYYCLQGIHLPFTFGPGTKVEIK

SEQ ID NO: 89 - protein, 111 aa, Artificial Sequence
  Description of Artificial Sequence: Synthetic polypeptide
DTVLTQSPASLAVSLGQRATISCRASESVHSYGNSLIHWYQQKPGQPPRLLIYRASNLESGIPARFSGSGSRTDFTLTINPVEADDVATYYCQQTNEDPLTFGAGTKLELK

SEQ ID NO: 90 - protein, 108 aa, Artificial Sequence
  Description of Artificial Sequence: Synthetic polypeptide
EIVLTQSPGTLSLSPGERVTLSCRASQRVNNNYLAWYQQRPGQAPRLLIYGASSRATGIPDRFSGSGSGTDFTLTISRLEPEDFAVYYCQQYDRSPLTFGGGTKLEIK

SEQ ID NO: 91 - protein, 106 aa, Artificial Sequence
  Description of Artificial Sequence: Synthetic polypeptide
QIVLTQSPAIMSASPGEKVTMTCSASSSVSYMHWYQQKSGTSPKRWIYDTSKLASGVPARFSGSGSGTSYSLTISSMEAEDAATYYCQQWSSNPLTFGAGTKLELK

SEQ ID NO: 92 - protein, 10 aa, Artificial Sequence
  Description of Artificial Sequence: Synthetic peptide
GFTFSSFGMH

SEQ ID NO: 93 - protein, 10 aa, Artificial Sequence
  Description of Artificial Sequence: Synthetic peptide
GYAFSDYWIN

SEQ ID NO: 94 - protein, 10 aa, Artificial Sequence
  Description of Artificial Sequence: Synthetic peptide
GYEFSSHWMN

SEQ ID NO: 95 - protein, 10 aa, Artificial Sequence
  Description of Artificial Sequence: Synthetic peptide
GYIFSNHWMN

SEQ ID NO: 96 - protein, 10 aa, Artificial Sequence
  Description of Artificial Sequence: Synthetic peptide
GYTFTSYWLN

SEQ ID NO: 97 - protein, 10 aa, Artificial Sequence
  Description of Artificial Sequence: Synthetic peptide
GYTFTSYWMN

SEQ ID NO: 98 - protein, 10 aa, Artificial Sequence
  Description of Artificial Sequence: Synthetic peptide
GYTFTSYWMN

SEQ ID NO: 99 - protein, 17 aa, Artificial Sequence
  Description of Artificial Sequence: Synthetic peptide
MIHPSDSESRLNQKFKD

SEQ ID NO: 100 - protein, 17 aa, Artificial Sequence
  Description of Artificial Sequence: Synthetic peptide
MIHPSDSETRLNQEFKD

SEQ ID NO: 101 - protein, 17 aa, Artificial Sequence
  Description of Artificial Sequence: Synthetic peptide
MIHPSDSETRLNQKFKD

SEQ ID NO: 102 - protein, 17 aa, Artificial Sequence
  Description of Artificial Sequence: Synthetic peptide
MIHPSDSETRLNQKFTD

SEQ ID NO: 103 - protein, 17 aa, Artificial Sequence
  Description of Artificial Sequence: Synthetic peptide
QIYPGDGDINYNEKFRG

SEQ ID NO: 104 - protein, 17 aa, Artificial Sequence
  Description of Artificial Sequence: Synthetic peptide
QIYPGDGDINYNGKFRG

SEQ ID NO: 105 - protein, 17 aa, Artificial Sequence
  Description of Artificial Sequence: Synthetic peptide
QVYPGDDDINYNGKFRG

SEQ ID NO: 106 - protein, 17 aa, Artificial Sequence
  Description of Artificial Sequence: Synthetic peptide
YISSGSSTIYYADTVKG

SEQ ID NO: 107 - protein, 8 aa, Artificial Sequence
  Description of Artificial Sequence: Synthetic peptide
HGNYVMDY

SEQ ID NO: 108 - protein, 8 aa, Artificial Sequence
  Description of Artificial Sequence: Synthetic peptide
HGNYVMDY

SEQ ID NO: 109 - protein, 12 aa, Artificial Sequence
  Description of Artificial Sequence: Synthetic peptide
QGIITSVQEFAY

SEQ ID NO: 110 - protein, 12 aa, Artificial Sequence
  Description of Artificial Sequence: Synthetic peptide
QGVITSVQEFAY

SEQ ID NO: 111 - protein, 11 aa, Artificial Sequence
  Description of Artificial Sequence: Synthetic peptide
WGYYGSSYFAY

SEQ ID NO: 112 - protein, 8 aa, Artificial Sequence
  Description of Artificial Sequence: Synthetic peptide
HGNYLMDY

SEQ ID NO: 113 - protein, 10 aa, Artificial Sequence
  Description of Artificial Sequence: Synthetic peptide
SASSSLNYIY

SEQ ID NO: 114 - protein, 10 aa, Artificial Sequence
  Description of Artificial Sequence: Synthetic peptide
SASSSVNYIF

SEQ ID NO: 115 - protein, 10 aa, Artificial Sequence
  Description of Artificial Sequence: Synthetic peptide
SASSSVNYIY

SEQ ID NO: 116 - protein, 10 aa, Artificial Sequence
  Description of Artificial Sequence: Synthetic peptide
SASSSVSYMF

SEQ ID NO: 117 - protein, 10 aa, Artificial Sequence
  Description of Artificial Sequence: Synthetic peptide
SVSSNVDYVF

SEQ ID NO: 118 - protein, 11 aa, Artificial Sequence
  Description of Artificial Sequence: Synthetic peptide
KASEDIYNRLA

SEQ ID NO: 119 - protein, 7 aa, Artificial Sequence
  Description of Artificial Sequence: Synthetic peptide
RTSNLAS

SEQ ID NO: 120 - protein, 7 aa, Artificial Sequence
  Description of Artificial Sequence: Synthetic peptide
RTSNLAT

SEQ ID NO: 121 - protein, 7 aa, Artificial Sequence
  Description of Artificial Sequence: Synthetic peptide
GATNLET

SEQ ID NO: 122 - protein, 9 aa, Artificial Sequence
  Description of Artificial Sequence: Synthetic peptide
QQFHDYPRT

SEQ ID NO: 123 - protein, 9 aa, Artificial Sequence
  Description of Artificial Sequence: Synthetic peptide
QQFHSYPRT

SEQ ID NO: 124 - protein, 9 aa, Artificial Sequence
  Description of Artificial Sequence: Synthetic peptide
QQFWRTPPT

SEQ ID NO: 125 - protein, 9 aa, Artificial Sequence
  Description of Artificial Sequence: Synthetic peptide
QQYHSYPLT

SEQ ID NO: 126 - protein, 10 aa, Artificial Sequence
  Description of Artificial Sequence: Synthetic peptide
CQQFWRTPPT

SEQ ID NO: 127 - protein, 117 aa, Artificial Sequence
  Description of Artificial Sequence: Synthetic polypeptide
EVQLVQSGAEVKKPGESLKISCKGSGYEFSSHWMNWVRQMPGKGLEWMGQIYPGDGDINYNEKFRGQVTISADKSISTAYLQWSSLKASDTAMYYCARHGNYVMDYWGQGTLVTVSS

SEQ ID NO: 128 - protein, 121 aa, Artificial Sequence
  Description of Artificial Sequence: Synthetic polypeptide
QVQLVQSGAEVKKPGSSVKVSCKASGYTFTSYWLNWVRQAPGQGLEWMGMIHPSDSESRLNQKFKDRVTITADKSTSTAYMELSSLRSEDTAVYYCARQGIITSVQEFAYWGQGTLVTVSS

SEQ ID NO: 129 - protein, 117 aa, Artificial Sequence
  Description of Artificial Sequence: Synthetic polypeptide
QVQLVQSGAEVKKPGASVKVSCKASGYEFSSHWMNWVRQAPGQGLEWMGQIYPGDGDINYNEKFRGRVTMTRDTSTSTVYMELSSLRSEDTAVYYCARHGNYVMDYWGQGTLVTVSS

SEQ ID NO: 130 - protein, 121 aa, Artificial Sequence
  Description of Artificial Sequence: Synthetic polypeptide
QVQLVQSGAEVKKPGASVKVSCKASGYTFTSYWMNWVRQAPGQGLEWIGMIHPSDSETRLNQKFKDRVTLTVDKSSSTAYMELSSLRSEDTAVYYCARQGIITSVQEFAYWGQGTLVTVSS

SEQ ID NO: 131 - protein, 121 aa, Artificial Sequence
  Description of Artificial Sequence: Synthetic polypeptide
QVQLVQSGAEVKKPGASVKVSCKASGYTFTSYWMNWVRQAPGQGLEWMGMIHPSDSETRLNQEFKDRVTMTRDTSTSTVYMELSSLRSEDTAVYYCARQGVITSVQEFAYWGQGTLVTVSS

SEQ ID NO: 132 - protein, 121 aa, Artificial Sequence
  Description of Artificial Sequence: Synthetic polypeptide
QVQLVQSGAEVKKPGASVKVSCKASGYTFTSYWMNWVRQAPGQGLEWMGMIHPSDSETRLNQKFKDRVTLTRDKSISTAYMELSRLRSDDTAVYYCARQGIITSVQEFAYWGQGTLVTVSS

SEQ ID NO: 133 - protein, 121 aa, Artificial Sequence
  Description of Artificial Sequence: Synthetic polypeptide
QVQLVQSGAEVKKPGASVKVSCKASGYTFTSYWMNWVRQAPGQGLEWMGMIHPSDSETRLNQKFKDRVTLTVDKSISTAYMELSRLRSDDTAVYYCARQGIITSVQEFAYWGQGTLVTVSS

SEQ ID NO: 134 - protein, 121 aa, Artificial Sequence
  Description of Artificial Sequence: Synthetic polypeptide
QVQLVQSGAEVKKPGASVKVSCKASGYTFTSYWMNWVRQAPGQGLEWMGMIHPSDSETRLNQKFKDRVTLTVDTSISTAYMELSRLRSDDTAVYYCARQGIITSVQEFAYWGQGTLVTVSS

SEQ ID NO: 135 - protein, 121 aa, Artificial Sequence
  Description of Artificial Sequence: Synthetic polypeptide
QVQLVQSGAEVKKPGASVKVSCKASGYTFTSYWMNWVRQAPGQGLEWMGMIHPSDSETRLNQKFKDRVTMTRDTSISTAYMELSRLRSDDTAVYYCARQGIITSVQEFAYWGQGTLVTVSS

SEQ ID NO: 136 - protein, 121 aa, Artificial Sequence
  Description of Artificial Sequence: Synthetic polypeptide
QVQLVQSGAEVKKPGASVKVSCKASGYTFTSYWMNWVRQAPGQGLEWMGMIHPSDSETRLNQKFKDRVTMTRDTSTSTVYMELSSLRSEDTAVYYCARQGIITSVQEFAYWGQGTLVTVSS

SEQ ID NO: 137 - protein, 121 aa, Artificial Sequence
  Description of Artificial Sequence: Synthetic polypeptide
QVQLVQSGAEVKKPGASVKVSCKASGYTFTSYWMNWVRQAPGQGLEWMGMIHPSDSETRLNQKFKDRVTMTVDKSISTAYMELSRLRSDDTAVYYCARQGIITSVQEFAYWGQGTLVTVSS

SEQ ID NO: 138 - protein, 121 aa, Artificial Sequence
  Description of Artificial Sequence: Synthetic polypeptide
QVQLVQSGAEVKKPGASVKVSCKASGYTFTSYWMNWVRQAPGQGLEWMGMIHPSDSETRLNQKFTDRVTMTRDTSTSTVYMELSSLRSEDTAVYYCARQGIITSVQEFAYWGQGTLVTVSS

SEQ ID NO: 139 - protein, 117 aa, Artificial Sequence
  Description of Artificial Sequence: Synthetic polypeptide
QVQLVQSGAEVKKPGSSVKVSCKASGYAFSDYWINWVRQAPGQGLEWMGQVYPGDDDINYNGKFRGRVTITADKSTSTAYMELSSLRSEDTAVYYCARHGNYVMDYWGQGTTVTVSS

SEQ ID NO: 140 - protein, 117 aa, Artificial Sequence
  Description of Artificial Sequence: Synthetic polypeptide
QVQLVQSGAEVKKPGSSVKVSCKASGYEFSSHWMNWVRQAPGQGLEWMGQIYPGDGDINYNEKFRGRVTITADKSTSTAYMELSSLRSEDTAVYYCARHGNYVMDYWGQGTTVTVSS

SEQ ID NO: 141 - protein, 117 aa, Artificial Sequence
  Description of Artificial Sequence: Synthetic polypeptide
QVQLVQSGAEVKKPGSSVKVSCKASGYIFSNHWMNWVRQAPGQGLEWMGQIYPGDGDINYNGKFRGRVTITADKSTSTAYMELSSLRSEDTAVYYCARHGNYLMDYWGQGTTVTVSS

SEQ ID NO: 142 - protein, 121 aa, Artificial Sequence; identical to SEQ ID NO: 128
  Description of Artificial Sequence: Synthetic polypeptide

SEQ ID NO: 143 - protein, 121 aa, Artificial Sequence
  Description of Artificial Sequence: Synthetic polypeptide
QVQLVQSGAEVKKPGSSVKVSCKASGYTFTSYWLNWVRQAPGQGLEWMGMIHPSDSETRLNQKFKDRVTITADKSTSTAYMELSSLRSEDTAVYYCARQGIITSVQEFAYWGQGTLVTVSS

SEQ ID NO: 144 - protein, 121 aa, Artificial Sequence
  Description of Artificial Sequence: Synthetic polypeptide
QVQLVQSGAEVKKPGSSVKVSCKASGYTFTSYWMNWVRQAPGQGLEWMGMIHPSDSESRLNQKFKDRVTITADKSTSTAYMELSSLRSEDTAVYYCARQGIITSVQEFAYWGQGTLVTVSS

SEQ ID NO: 145 - protein, 121 aa, Artificial Sequence
  Description of Artificial Sequence: Synthetic polypeptide
QVQLVQSGAEVKKPGSSVKVSCKASGYTFTSYWMNWVRQAPGQGLEWMGMIHPSDSETRLNQKFKDRVTITADKSTSTAYMELSSLRSEDTAVYYCARQGIITSVQEFAYWGQGTLVTVSS

SEQ ID NO: 146 - protein, 120 aa, Artificial Sequence
  Description of Artificial Sequence: Synthetic polypeptide
EVQLVESGGGLVQPGGSLRLSCAASGFTFSSFGMHWVRQAPGKGLEWVSYISSGSSTIYYADTVKGRFTISRDNAKNSLYLQMNSLRAEDTAVYYCARWGYYGSSYFAYWGQGTLVTVSS

SEQ ID NO: 147 - protein, 107 aa, Artificial Sequence
  Description of Artificial Sequence: Synthetic polypeptide
DIQMTQSPSSLSASVGDRVTITCKASEDIYNRLAWYQQKPGKAPKLLIYGATNLETGVPSRFSGSGSGTDFTFTISSLQPEDIATYYCQQFWRTPPTFGGGTKVEIK

SEQ ID NO: 148 - protein, 107 aa, Artificial Sequence
  Description of Artificial Sequence: Synthetic polypeptide
DIQMTQSPSSLSASVGDRVTITCKASEDIYNRLAWYQQKPGKAPKPLISGATNLETGVPSRFSGSGSGKDYTLTISSLQPEDIATYYCQQFWRTPPTFGGGTKVEIK

SEQ ID NO: 149 - protein, 107 aa, Artificial Sequence
  Description of Artificial Sequence: Synthetic polypeptide
DIQMTQSPSSLSASVGDRVTITCKASEDIYNRLAWYQQKPGKAPKPLISGATNLETGVPSRFSGSGSGTDFTFTISSLQPEDIATYYCQQFWRTPPTFGGGTKVEIK

SEQ ID NO: 150 - protein, 107 aa, Artificial Sequence
  Description of Artificial Sequence: Synthetic polypeptide
DIQMTQSPSSLSASVGDRVTITCKASEDIYNRLAWYQQKPGKAPKPLIYGATNLETGVPSRFSGSGSGTDFTFTISSLQPEDIATYYCQQFWRTPPTFGGGTKVEIK

SEQ ID NO: 151 - protein, 106 aa, Artificial Sequence
  Description of Artificial Sequence: Synthetic polypeptide
EIVLTQSPATLSLSPGERATLSCSASSSVNYIFWYQQKPGQAPRLLIYRTSNLASGIPARFSGSGSGTDFTLTISSLEPEDFAVYYCQQYHSYPLTFGGGTKVEIK

SEQ ID NO: 152 - protein, 106 aa, Artificial Sequence
  Description of Artificial Sequence: Synthetic polypeptide
EIVLTQSPATLSLSPGERATLSCSASSSVNYIYWYQQKPGQAPRLLIYRTSNLASGIPARFSGSGSGTDFTLTISSLEPEDFAVYYCQQYHSYPLTFGGGTKVEIK

SEQ ID NO: 153 - protein, 106 aa, Artificial Sequence
  Description of Artificial Sequence: Synthetic polypeptide
EIVLTQSPATLSLSPGERATLSCSASSSVSYMFWYQQKPGQAPRLLIYRTSNLASGIPARFSGSGSGTDFTLTISSLEPEDFAVYYCQQFHDYPRTFGGGTKVEIK

SEQ ID NO: 154 - protein, 106 aa, Artificial Sequence
  Description of Artificial Sequence: Synthetic polypeptide
EIVLTQSPATLSLSPGERATLSCSASSSVSYMFWYQQKPGQAPRLLIYRTSNLASGIPARFSGSGSGTDFTLTISSLEPEDFAVYYCQQFHSYPRTFGGGTKVEIK

SEQ ID NO: 155 - protein, 106 aa, Artificial Sequence
  Description of Artificial Sequence: Synthetic polypeptide
EIVLTQSPATLSLSPGERATLSCSASSSVSYMFWYQQKPGQAPRPWIYRTSNLASGIPPRFSGSGSGTDYTLTISSLEPEDFAVYYCQQFHDYPRTFGGGTKVEIK

SEQ ID NO: 156 - protein, 106 aa, Artificial Sequence
  Description of Artificial Sequence: Synthetic polypeptide
EIVLTQSPATLSLSPGERATLSCSVSSNVDYVFWYQQKPGQAPRLLIYRTSNLATGIPARFSGSGSGTDFTLTISSLEPEDFAVYYCQQFHSYPRTFGGGTKVEIK

SEQ ID NO: 157 - protein, 106 aa, Artificial Sequence
  Description of Artificial Sequence: Synthetic polypeptide
EIVLTQSPATLSVSPGERATLSCSASSSVNYIYWYQQKPGQAPRPWIYRTSNLASGIPARFSGSGSGTEYTLTISSLQSEDFAVYYCQQYHSYPLTFGGGTKVEIK

SEQ ID NO: 158 - protein, 106 aa, Artificial Sequence
  Description of Artificial Sequence: Synthetic polypeptide
EIVMTQSPATLSVSPGERATLSCSASSSLNYIYWYQQKPGQAPRLLIYRTSNLASGIPARFSGSGSGTEFTLTISSLQSEDFAVYYCQQYHSYPLTFGGGTKVEIK

SEQ ID NO: 159 - protein, 106 aa, Artificial Sequence
  Description of Artificial Sequence: Synthetic polypeptide
EIVMTQSPATLSVSPGERATLSCSASSSVNYIYWYQQKPGQAPRLLIYRTSNLASGIPARFSGSGSGTEFTLTISSLQSEDFAVYYCQQYHSYPLTFGGGTKVEIK

SEQ ID NO: 160 - protein, 106 aa, Artificial Sequence
  Description of Artificial Sequence: Synthetic polypeptide
EIVMTQSPATLSVSPGERATLSCSASSSVSYMFWYQQKPGQAPRLLIYRTSNLASGIPARFSGSGSGTEFTLTISSLQSEDFAVYYCQQFHDYPRTFGGGTKVEIK

SEQ ID NO: 161 - protein, 105 aa, Artificial Sequence
  Description of Artificial Sequence: Synthetic polypeptide
IQLTQSPSFLSASVGDRVTITCSASSSVSYMFWYQQKPGKAPKLLIYRTSNLASGVPPRFSGSGSGTEFTLTISSLQPEDFATYYCQQFHDYPRTFGGGTKVEIK

SEQ ID NO: 162 - protein, 106 aa, Artificial Sequence
  Description of Artificial Sequence: Synthetic polypeptide
IQLTQSPSFLSASVGDRVTITCSASSSVSYMFWYQQKPGKAPKLLIYRTSNLASGVPPRFSGSGSGTEYTLTISSLQPEDFATYYCQQFHDYPRTFGGGTKVEIKR

SEQ ID NO: 163 - protein, 105 aa, Artificial Sequence
  Description of Artificial Sequence: Synthetic polypeptide
IQLTQSPSFLSASVGDRVTITCSASSSVSYMFWYQQKPGKAPKLLIYRTSNLASGVPSRFSGSGSGTEFTLTISSLQPEDFATYYCQQFHDYPRTFGGGTKVEIK

SEQ ID NO: 164 - protein, 105 aa, Artificial Sequence
  Description of Artificial Sequence: Synthetic polypeptide
IQLTQSPSFLSASVGDRVTITCSASSSVSYMFWYQQKPGKAPKLLIYRTSNLASGVPSRFSGSGSGTEYTLTISSLQPEDFATYYCQQFHDYPRTFGGGTKVEIK

SEQ ID NO: 165 - protein, 105 aa, Artificial Sequence
  Description of Artificial Sequence: Synthetic polypeptide
IQLTQSPSFLSASVGDRVTITCSASSSVSYMFWYQQKPGKAPKPWIYRTSNLASGVPPRFSGSGSGTEYTLTISSLQPEDFATYYCQQFHDYPRTFGGGTKVEIK

SEQ ID NO: 166 - protein, 105 aa, Artificial Sequence
  Description of Artificial Sequence: Synthetic polypeptide
IQLTQSPSFLSASVGDRVTITCSASSSVSYMFWYQQKPGKAPKPWIYRTSNLASGVPSRFSGSGSGTEFTLTISSLQPEDFATYYCQQFHDYPRTFGGGTKVEIK

SEQ ID NO: 167 - protein, 105 aa, Artificial Sequence
  Description of Artificial Sequence: Synthetic polypeptide
IQMTQSPSSLSASVGDRVTITCSASSSVNYIFWYQQKPGKAPKLLIYRTSNLASGVPSRFSGSGSGTDFTLTISSLQPEDFATYYCQQYHSYPLTFGGGTKVEIK

SEQ ID NO: 168 - protein, 105 aa, Artificial Sequence
  Description of Artificial Sequence: Synthetic polypeptide
IQMTQSPSSLSASVGDRVTITCSASSSVNYIYWYQQKPGKAPKLLIYRTSNLASGVPSRFSGSGSGTDFTLTISSLQPEDFATYYCQQYHSYPLTFGGGTKVEIK

SEQ ID NO: 169 - protein, 107 aa, Artificial Sequence
  Description of Artificial Sequence: Synthetic polypeptide
DIQMTQSPSSLSASVGDRVTITCKASEDIYNRLAWYQQKPGKAPKLLIYGATNLETGVPSRFSGSGSGKDYTLTISSLQPEDIATYYCQQFWRTPPTFGGGTKVEIK

SEQ ID NO: 170 - protein, 10 aa, Artificial Sequence
  Description of Artificial Sequence: Synthetic peptide
GFTFSSFGMH

SEQ ID NO: 171 - protein, 10 aa, Artificial Sequence
  Description of Artificial Sequence: Synthetic peptide
GYAFNNYWMN

SEQ ID NO: 172 - protein, 10 aa, Artificial Sequence
  Description of Artificial Sequence: Synthetic peptide
GYAFSSYWMN

SEQ ID NO: 173 - protein, 10 aa, Artificial Sequence
  Description of Artificial Sequence: Synthetic peptide
GYTFTNFGIT

SEQ ID NO: 174 - protein, 10 aa, Artificial Sequence
  Description of Artificial Sequence: Synthetic peptide
GYTFTNSGMN

SEQ ID NO: 175 - protein, 10 aa, Artificial Sequence
  Description of Artificial Sequence: Synthetic peptide
GYTFTNYGMN

SEQ ID NO: 176 - protein, 17 aa, Artificial Sequence
  Description of Artificial Sequence: Synthetic peptide
EIYPSSGNTFYNEKFKG

SEQ ID NO: 177 - protein, 17 aa, Artificial Sequence
  Description of Artificial Sequence: Synthetic peptide
QISPGNGNSNFNGKFKG

SEQ ID NO: 178 - protein, 17 aa, Artificial Sequence
  Description of Artificial Sequence: Synthetic peptide
QIYPGNGNSNFNGKFKA

SEQ ID NO: 179 - protein, 17 aa, Artificial Sequence
  Description of Artificial Sequence: Synthetic peptide
WINTNTGEPTFAEEFRG

SEQ ID NO: 180 - protein, 17 aa, Artificial Sequence
  Description of Artificial Sequence: Synthetic peptide
WINTNTGEPTYAEEFKG

SEQ ID NO: 181 - protein, 17 aa, Artificial Sequence
  Description of Artificial Sequence: Synthetic peptide
YISSGNSAIYYADTVNG

SEQ ID NO: 182 - protein, 12 aa, Artificial Sequence
  Description of Artificial Sequence: Synthetic peptide
GGGPLRSRYFDY

SEQ ID NO: 183 - protein, 10 aa, Artificial Sequence
  Description of Artificial Sequence: Synthetic peptide
GGRFGNAMDY

SEQ ID NO: 184 - protein, 10 aa, Artificial Sequence
  Description of Artificial Sequence: Synthetic peptide
GGRYGNAMDY

SEQ ID NO: 185 - protein, 9 aa, Artificial Sequence
  Description of Artificial Sequence: Synthetic peptide
LRYGNSFDY

SEQ ID NO: 186 - protein, 9 aa, Artificial Sequence
  Description of Artificial Sequence: Synthetic peptide
YFYGNSFVY

SEQ ID NO: 187 - protein, 9 aa, Artificial Sequence
  Description of Artificial Sequence: Synthetic peptide
YYYGNSFAY

SEQ ID NO: 188 - protein, 17 aa, Artificial Sequence
  Description of Artificial Sequence: Synthetic peptide
KSSQSLLNSGNQKNYLT

SEQ ID NO: 189 - protein, 17 aa, Artificial Sequence
  Description of Artificial Sequence: Synthetic peptide
KSSQSLLNSGNQRNYLT

SEQ ID NO: 190 - protein, 17 aa, Artificial Sequence
  Description of Artificial Sequence: Synthetic peptide
RSSQSLFSSGNQKNYLT

SEQ ID NO: 191 - protein, 7 aa, Artificial Sequence
  Description of Artificial Sequence: Synthetic peptide
WASTRES

SEQ ID NO: 192 - protein, 9 aa, Artificial Sequence
  Description of Artificial Sequence: Synthetic peptide
QNAYFYPYT

SEQ ID NO: 193 - protein, 9 aa, Artificial Sequence
  Description of Artificial Sequence: Synthetic peptide
QNDYYYPLT

SEQ ID NO: 194 - protein, 9 aa, Artificial Sequence
  Description of Artificial Sequence: Synthetic peptide
QNNYFYPLT

SEQ ID NO: 195 - protein, 9 aa, Artificial Sequence
  Description of Artificial Sequence: Synthetic peptide
QNNYNFPLT

SEQ ID NO: 196 - protein, 9 aa, Artificial Sequence
  Description of Artificial Sequence: Synthetic peptide
QNNYYYPLT

SEQ ID NO: 197 - protein, 118 aa, Artificial Sequence
  Description of Artificial Sequence: Synthetic polypeptide
EVQLVESGGGLVQPGGSLRLSCAASGFTFSSFGMHWVRQAPGKGLEWVAYISSGNSAIYYADTVNGRFTISRDNPKNTLYLQMNSLRAEDTAVYYCARLRYGNSFDYWGQGTLVTVSS

SEQ ID NO: 198 - protein, 118 aa, Artificial Sequence
  Description of Artificial Sequence: Synthetic polypeptide
EVQLVESGGGLVQPGGSLRLSCAASGFTFSSFGMHWVRQAPGKGLEWVSYISSGNSAIYYADTVNGRFTISRDNAKNSLYLQMNSLRAEDTAVYYCARLRYGNSFDYWGQGTLVTVSS

SEQ ID NO: 199 - protein, 118 aa, Artificial Sequence
  Description of Artificial Sequence: Synthetic polypeptide
QIQLVQSGAEVKKPGASVKVSCKASGYTFTNSGMNWVRQAPGQGLEWMGWINTNTGEPTFAEEFRGRVTFTLDTSASTAYMELSRLRSDDTAVYYCARYYYGNSFAYWGQGTLVTVSS

SEQ ID NO: 200 - protein, 121 aa, Artificial Sequence
  Description of Artificial Sequence: Synthetic polypeptide
QVQLVQSGAEVKKPGASVKVSCKASGYTFTNFGITWVRQAPGQGLEWIGEIYPSSGNTFYNEKFKGRVTLTADKSSSAAYMELRSLRSDDTAVYYCARGGGPLRSRYFDYWGQGTLVTVSS

SEQ ID NO: 201 - protein, 121 aa, Artificial Sequence
  Description of Artificial Sequence: Synthetic polypeptide
QVQLVQSGAEVKKPGASVKVSCKASGYTFTNFGITWVRQAPGQGLEWMGEIYPSSGNTFYNEKFKGRVTMTTDTSTSTAYMELRSLRSDDTAVYYCARGGGPLRSRYFDYWGQGTLVTVSS

SEQ ID NO: 202 - protein, 118 aa, Artificial Sequence
  Description of Artificial Sequence: Synthetic polypeptide
QVQLVQSGAEVKKPGASVKVSCKASGYTFTNSGMNWVRQAPGQGLEWMGWINTNTGEPTFAEEFRGRVTMTRDTSISTAYMELSRLRSDDTAVYYCARYYYGNSFAYWGQGTLVTVSS

SEQ ID NO: 203 - protein, 118 aa, Artificial Sequence
  Description of Artificial Sequence: Synthetic polypeptide
QVQLVQSGAEVKKPGASVKVSCKASGYTFTNYGMNWVRQAPGQGLEWMGWINTNTGEPTYAEEFKGRVTMTRDTSISTAYMELSRLRSDDTAVYYCARYFYGNSFVYWGQGTLVTVSS

SEQ ID NO: 204 - protein, 119 aa, Artificial Sequence
  Description of Artificial Sequence: Synthetic polypeptide
QVQLVQSGAEVKKPGSSVKVSCKASGYAFNNYWMNWVRQAPGQGLEWMGQISPGNGNSNFNGKFKGRVTITADKSTSTAYMELSSLRSEDTAVYYCARGGRYGNAMDYWGQGTTVTVSS

SEQ ID NO: 205 - protein, 119 aa, Artificial Sequence
  Description of Artificial Sequence: Synthetic polypeptide
QVQLVQSGAEVKKPGSSVKVSCKASGYAFSSYWMNWVRQAPGQGLEWIGQIYPGNGNSNFNGKFKARVTLTADKSSSTAYMELSSLRSEDTAVYYCARGGRFGNAMDYWGQGTTVTVSS

SEQ ID NO: 206 - protein, 119 aa, Artificial Sequence
  Description of Artificial Sequence: Synthetic polypeptide
QVQLVQSGAEVKKPGSSVKVSCKASGYAFSSYWMNWVRQAPGQGLEWMGQIYPGNGNSNFNGKFKARVTITADKSTSTAYMELSSLRSEDTAVYYCARGGRFGNAMDYWGQGTTVTVSS

SEQ ID NO: 207 - protein, 113 aa, Artificial Sequence
  Description of Artificial Sequence: Synthetic polypeptide
DIVMTQSPDSLAVSLGERATINCKSSQSLLNSGNQKNYLTWYQQKPGQPPKLLIFWASTRESGVPDRFSGSGSGTDFTLTISSLQAEDVAVYYCQNNYYYPLTFGGGTKVEIK

SEQ ID NO: 208 - protein, 113 aa, Artificial Sequence
  Description of Artificial Sequence: Synthetic polypeptide
DIVMTQSPDSLAVSLGERATINCKSSQSLLNSGNQKNYLTWYQQKPGQPPKLLIYWASTRESGVPDRFSGSGSGTDFTLTISSLQAEDVAVYYCQNNYNFPLTFGGGTKVEIK

SEQ ID NO: 209 - protein, 113 aa, Artificial Sequence
  Description of Artificial Sequence: Synthetic polypeptide
DIVMTQSPDSLAVSLGERATINCKSSQSLLNSGNQKNYLTWYQQKPGQPPKLLIYWASTRESGVPDRFSGSGSGTDFTLTISSLQAEDVAVYYCQNNYYYPLTFGGGTKVEIK

SEQ ID NO: 210 - protein, 113 aa, Artificial Sequence
  Description of Artificial Sequence: Synthetic polypeptide
DIVMTQSPDSLAVSLGERATINCKSSQSLLNSGNQRNYLTWYQQKPGQPPKLLIYWASTRESGVPDRFSGSGSGTDFTLTISSLQAEDVAVYYCQNAYFYPYTFGGGTKVEIK

SEQ ID NO: 211 - protein, 113 aa, Artificial Sequence
  Description of Artificial Sequence: Synthetic polypeptide
DIVMTQSPDSLAVSLGERATINCRSSQSLFSSGNQKNYLTWYQQKPGQPPKLLIYWASTRESGVPDRFSGSGSGADFTLTISSLQAEDVAVYYCQNDYYYPLTFGGGTKVEIK

SEQ ID NO: 212 - protein, 113 aa, Artificial Sequence
  Description of Artificial Sequence: Synthetic polypeptide
DIVMTQSPDSLAVSLGERATINCRSSQSLFSSGNQKNYLTWYQQKPGQPPKLLIYWASTRESGVPDRFSGSGSGTDFTLTISSLQAEDVAVYYCQNDYYYPLTFGGGTKVEIK

SEQ ID NO: 213 - protein, 113 aa, Artificial Sequence
  Description of Artificial Sequence: Synthetic polypeptide
DIVMTQSPDSLAVSLGERATMNCKSSQSLLNSGNQKNYLTWYQQKPGQPPKLLIYWASTRESGVPDRFSGSGSGTDFTLTISSLQAEDVAVYYCQNAYFYPYTFGGGTKVEIK

SEQ ID NO: 214 - protein, 113 aa, Artificial Sequence
  Description of Artificial Sequence: Synthetic polypeptide
DIVMTQSPDSLAVSLGERATINCKSSQSLLNSGNQKNYLTWYQQKPGQPPKLLIYWASTRESGVPDRFSGSGSGTDFTLTISSLQAEDVAVYYCQNAYFYPYTFGGGTKVEIK

SEQ ID NO: 215 - protein, 113 aa, Artificial Sequence
  Description of Artificial Sequence: Synthetic polypeptide
DIVMTQSPDSLAVSLGERATINCKSSQSLLNSGNQKNYLTWYQQKPGQPPKLLIYWASTRESGVPDRFSGSGSGTDFTLTISSLQAEDVAVYYCQNNYFYPLTFGGGTKVEIK

SEQ ID NO: 216 - protein, 6 aa, Artificial Sequence
  Description of Artificial Sequence: Synthetic peptide
SGGGGS

SEQ ID NO: 217 - protein, 330 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 218 - protein, 330 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 219 - protein, 330 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 220 - protein, 330 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLTCLVEGFYPSDIAVEWESNGQPENNYKTTPPVLDSDGSFFLYSDLTVDKSRWQQGNVFSCSVMHEALHNHYTQESLSLSPGK

SEQ ID NO: 221 - protein, 330 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 222 - protein, 330 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 223 - protein, 330 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 224 - protein, 330 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVCTLPPSRDELTKNQVSLTCLVEGFYPSDIAVEWESNGQPENNYKTTPPVLDSDGSFFLYSDLTVDKSRWQQGNVFSCSVMHEALHNHYTQESLSLSPGK

SEQ ID NO: 225 - protein, 330 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 226 - protein, 330 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 227 - protein, 330 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 228 - protein, 330 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLTCLVEGFYPSDIAVEWESNGQPENNYKTTPPVLDSDGSFFLYSDLTVDKSRWQQGNVFSCSVMHEALHNHYTQESLSLSPGK

SEQ ID NO: 229 - protein, 330 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 230 - protein, 330 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 231 - protein, 330 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 232 - protein, 232 aa, Artificial Sequence
  Description of Artificial Sequence: Synthetic polypeptide
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 233 - protein, 232 aa, Artificial Sequence
  Description of Artificial Sequence: Synthetic polypeptide
EPKSSDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 234 - protein, 232 aa, Artificial Sequence
  Description of Artificial Sequence: Synthetic polypeptide
EPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 235 - protein, 232 aa, Artificial Sequence
  Description of Artificial Sequence: Synthetic polypeptide
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLTCLVEGFYPSDIAVEWESNGQPENNYKTTPPVLDSDGSFFLYSDLTVDKSRWQQGNVFSCSVMHEALHNHYTQESLSLSPGK

SEQ ID NO: 236 - protein, 232 aa, Artificial Sequence
  Description of Artificial Sequence: Synthetic polypeptide
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 237 - protein, 232 aa, Artificial Sequence
  Description of Artificial Sequence: Synthetic polypeptide
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 238 - protein, 232 aa, Artificial Sequence
  Description of Artificial Sequence: Synthetic polypeptide
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 239 - protein, 232 aa, Artificial Sequence
  Description of Artificial Sequence: Synthetic polypeptide
EPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVCTLPPSRDELTKNQVSLTCLVEGFYPSDIAVEWESNGQPENNYKTTPPVLDSDGSFFLYSDLTVDKSRWQQGNVFSCSVMHEALHNHYTQESLSLSPGK

SEQ ID NO: 240 - protein, 232 aa, Artificial Sequence
  Description of Artificial Sequence: Synthetic polypeptide
EPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 241 - protein, 232 aa, Artificial Sequence
  Description of Artificial Sequence: Synthetic polypeptide
EPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 242 - protein, 232 aa, Artificial Sequence
  Description of Artificial Sequence: Synthetic polypeptide
EPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 243 - protein, 232 aa, Artificial Sequence
  Description of Artificial Sequence: Synthetic polypeptide
EPKSSDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLTCLVEGFYPSDIAVEWESNGQPENNYKTTPPVLDSDGSFFLYSDLTVDKSRWQQGNVFSCSVMHEALHNHYTQESLSLSPGK

SEQ ID NO: 244 - protein, 232 aa, Artificial Sequence
  Description of Artificial Sequence: Synthetic polypeptide
EPKSSDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 245 - protein, 232 aa, Artificial Sequence
  Description of Artificial Sequence: Synthetic polypeptide
EPKSSDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 246 - protein, 232 aa, Artificial Sequence
  Description of Artificial Sequence: Synthetic polypeptide
EPKSSDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 247 - protein, 107 aa, Artificial Sequence [sequence omitted]

SEQ ID NO: 248 - protein, 125 aa, Artificial Sequence
  Description of Artificial Sequence: Synthetic polypeptide
EVQLVESGGGLVQPKGSLKLSCAASGFTFNTYAMNWVRQAPGKGLEWVARIRSKYNNYATYYADSVKDRFTISRDDSQSILYLQMNNLKTEDTAMYYCVRHGNFGNSYVSWFAYWGQGTLVTVSS

SEQ ID NO: 249 - protein, 125 aa, Artificial Sequence
  Description of Artificial Sequence: Synthetic polypeptide
EVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSS

SEQ ID NO: 250 - protein, 125 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSS

SEQ ID NO: 251 - protein, 125 aa, Artificial Sequence
  Description of Artificial Sequence: Synthetic polypeptide
EVQLVESGGGLVQPGGSLRLSCAASGFTFSTYAMNWVRQAPGKGLEWVGRIRSKINNYATYYADSVKGRFTISRDDSKNTLYLQMNSLRAEDTAVYYCVRHGNFGDSYVSWFAYWGQGTLVTVSS

SEQ ID NO: 252 - protein, 125 aa, Artificial Sequence
  Description of Artificial Sequence: Synthetic polypeptide
EVQLVESGGGLVQPGGSLRLSCAASGFTFSTYAMNWVRQAPGKGLEWVGRIRSKLNNYATYYADSVKGRFTISRDDSKNTLYLQMNSLRAEDTAVYYCVRHGNFGDSYVSWFAYWGQGTLVTVSS

SEQ ID NO: 253 - protein, 125 aa, Artificial Sequence
  Description of Artificial Sequence: Synthetic polypeptide
EVQLVESGGGLVQPGGSLRLSCAASGFTFSTYAMNWVRQAPGKGLEWVGRIRSKVNNYATYYADSVKGRFTISRDDSKNTLYLQMNSLRAEDTAVYYCVRHGNFGDSYVSWFAYWGQGTLVTVSS

SEQ ID NO: 254 - protein, 125 aa, Artificial Sequence
  Description of Artificial Sequence: Synthetic polypeptide
EVQLVESGGGLVQPGGSLRLSCAASGFTFSTYAMNWVRQAPGKGLEWVGRIRSKSNNYATYYADSVKGRFTISRDDSKNTLYLQMNSLRAEDTAVYYCVRHGNFGDSYVSWFAYWGQGTLVTVSS

SEQ ID NO: 255 - protein, 125 aa, Artificial Sequence
  Description of Artificial Sequence: Synthetic polypeptide
EVQLVESGGGLVQPGGSLRLSCAASGFTFSTYAMDWVRQAPGKGLEWVGRIRSKYNNYATYYADSVKGRFTISRDDSKNTLYLQMNSLRAEDTAVYYCVRHGNFGDSYVSWFAYWGQGTLVTVSS

SEQ ID NO: 256 - protein, 125 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFEYWGQGTLVTVSS

SEQ ID NO: 257 - protein, 125 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSS

SEQ ID NO: 258 - protein, 125 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFNYWGQGTLVTVSS

SEQ ID NO: 259 - protein, 125 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSYFAYWGQGTLVTVSS

SEQ ID NO: 260 - protein, 123 aa, Artificial Sequence
  Description of Artificial Sequence: Synthetic polypeptide
QLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSS

SEQ ID NO: 261 - protein, 109 aa, Artificial Sequence
  Description of Artificial Sequence: Synthetic polypeptide
QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 262 - protein, 486 aa, Artificial Sequence
  Description of Artificial Sequence: Synthetic polypeptide
EVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 263 - protein, 486 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 264 - protein, 486 aa, Artificial Sequence
  Description of Artificial Sequence: Synthetic polypeptide
EVQLVESGGGLVQPGGSLRLSCAASGFTFSTYAMNWVRQAPGKGLEWVGRIRSKINNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 265 - protein, 486 aa, Artificial Sequence
  Description of Artificial Sequence: Synthetic polypeptide
EVQLVESGGGLVQPGGSLRLSCAASGFTFSTYAMNWVRQAPGKGLEWVGRIRSKLNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 266 - protein, 486 aa, Artificial Sequence
  Description of Artificial Sequence: Synthetic polypeptide
EVQLVESGGGLVQPGGSLRLSCAASGFTFSTYAMNWVRQAPGKGLEWVGRIRSKVNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 267 - protein, 486 aa, Artificial Sequence
  Description of Artificial Sequence: Synthetic polypeptide
EVQLVESGGGLVQPGGSLRLSCAASGFTFSTYAMNWVRQAPGKGLEWVGRIRSKSNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 268 - protein, 486 aa, Artificial Sequence
  Description of Artificial Sequence: Synthetic polypeptide
EVQLVESGGGLVQPGGSLRLSCAASGFTFSTYAMDWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 269 - protein, 486 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFEYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 270 - protein, 486 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 271 - protein, 486 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFNYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 272 - protein, 486 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSYFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 273 - protein, 484 aa, Artificial Sequence
  Description of Artificial Sequence: Synthetic polypeptide
QLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 274 - protein, 448 aa, Artificial Sequence
  Description of Artificial Sequence: Synthetic polypeptide
EVQLLESGGGLVQPGGSLRLSCAASGFTFSSYGMHWVRQAPGKGLEWVAVISGSGSSKYYADSVKGRFTISRDNSKNTLYLQMNSLRAEDTAVYYCARDWFFYLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVCTLPPSRDELTKNQVSLTCLVEGFYPSDIAVEWESNGQPENNYKTTPPVLDSDGSFFLYSDLTVDKSRWQQGNVFSCSVMHEALHNHYTQESLSLSPGK

SEQ ID NO: 275 - protein, 448 aa, Artificial Sequence
  Description of Artificial Sequence: Synthetic polypeptide
EVQLLESGGGLVQPGGSLRLSCAASGFTFSSYGMHWVRQAPGKGLEWVAVISGSGSSKYYADSVKGRFTISRDNSKNTLYLQMNSLRAEDTAVYYCARDWFYFIFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVCTLPPSRDELTKNQVSLTCLVEGFYPSDIAVEWESNGQPENNYKTTPPVLDSDGSFFLYSDLTVDKSRWQQGNVFSCSVMHEALHNHYTQESLSLSPGK

SEQ ID NO: 276 - protein, 448 aa, Artificial Sequence
  Description of Artificial Sequence: Synthetic polypeptide
EVQLLESGGGLVQPGGSLRLSCAASGFTFSSYGMHWVRQAPGKGLEWVAVISHHGSSKYYADSVKGRFTISRDNSKNTLYLQMNSLRAEDTAVYYCARDWFFYLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVCTLPPSRDELTKNQVSLTCLVEGFYPSDIAVEWESNGQPENNYKTTPPVLDSDGSFFLYSDLTVDKSRWQQGNVFSCSVMHEALHNHYTQESLSLSPGK

SEQ ID NO: 277 - protein, 448 aa, Artificial Sequence
  Description of Artificial Sequence: Synthetic polypeptide
EVQLLESGGGLVQPGGSLRLSCAASGFTFSSYGMHWVRQAPGKGLEWVAVISHHGSSKYYADSVKGRFTISRDNSKNTLYLQMNSLRAEDTAVYYCARDWFYFIFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVCTLPPSRDELTKNQVSLTCLVEGFYPSDIAVEWESNGQPENNYKTTPPVLDSDGSFFLYSDLTVDKSRWQQGNVFSCSVMHEALHNHYTQESLSLSPGK

SEQ ID NO: 278 - protein, 448 aa, Artificial Sequence
  Description of Artificial Sequence: Synthetic polypeptide
EVQLLESGGGLVQPGGSLRLSCAASGFTFSSYGMHWVRQAPGKGLEWVAVISYDGSSKYYADSVKGRFTISRDNSKNTLYLQMNSLRAEDTAVYYCARDWFFYLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVCTLPPSRDELTKNQVSLTCLVEGFYPSDIAVEWESNGQPENNYKTTPPVLDSDGSFFLYSDLTVDKSRWQQGNVFSCSVMHEALHNHYTQESLSLSPGK

SEQ ID NO: 279 - protein, 448 aa, Artificial Sequence
  Description of Artificial Sequence: Synthetic polypeptide
EVQLLESGGGLVQPGGSLRLSCAASGFTFSSYGMHWVRQAPGKGLEWVAVISYDGSSKYYADSVKGRFTISRDNSKNTLYLQMNSLRAEDTAVYYCARDWFYFIFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVCTLPPSRDELTKNQVSLTCLVEGFYPSDIAVEWESNGQPENNYKTTPPVLDSDGSFFLYSDLTVDKSRWQQGNVFSCSVMHEALHNHYTQESLSLSPGK

SEQ ID NO: 280 - protein, 448 aa, Artificial Sequence
  Description of Artificial Sequence: Synthetic polypeptide
EVQLLESGGGLVQPGGSLRLSCAASGFTFSSYGMHWVRQAPGKGLEWVSVISHHGSSKYYADSVKGRFTISRDNSKNTLYLQMNSLRAEDTAVYYCAKDWFFYLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVCTLPPSRDELTKNQVSLTCLVEGFYPSDIAVEWESNGQPENNYKTTPPVLDSDGSFFLYSDLTVDKSRWQQGNVFSCSVMHEALHNHYTQESLSLSPGK

SEQ ID NO: 281 - protein, 448 aa, Artificial Sequence
  Description of Artificial Sequence: Synthetic polypeptide
EVQLLESGGGLVQPGGSLRLSCAASGFTFSSYGMHWVRQAPGKGLEWVSVISHHGSSKYYADSVKGRFTISRDNSKNTLYLQMNSLRAEDTAVYYCAKDWFYFIFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVCTLPPSRDELTKNQVSLTCLVEGFYPSDIAVEWESNGQPENNYKTTPPVLDSDGSFFLYSDLTVDKSRWQQGNVFSCSVMHEALHNHYTQESLSLSPGK

SEQ ID NO: 282 - protein, 450 aa, Artificial Sequence
  Description of Artificial Sequence: Synthetic polypeptide
EVQLQQSGPVLVKPGASVKMSCKASGFTFTDYYMNWVKQSHGKSLEWIGVINPDNGITTYNQKFKGKATLTVDKSSSTAYMELNGLTSEDSAVYYCARGVWNYERSFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVCTLPPSRDELTKNQVSLTCLVEGFYPSDIAVEWESNGQPENNYKTTPPVLDSDGSFFLYSDLTVDKSRWQQGNVFSCSVMHEALHNHYTQESLSLSPGK

SEQ ID NO: 283 - protein, 448 aa, Artificial Sequence
  Description of Artificial Sequence: Synthetic polypeptide
EVQLVESGGGLVQPGGSLRLSCAASGFTFSNYGMHWVRQAPGKGLEWVAVISHHGSSKYYADSVKGRYTISRDNSKNTLYLQMNSLRAEDTAVYYCARDWFFYLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVCTLPPSRDELTKNQVSLTCLVEGFYPSDIAVEWESNGQPENNYKTTPPVLDSDGSFFLYSDLTVDKSRWQQGNVFSCSVMHEALHNHYTQESLSLSPGK

SEQ ID NO: 284 - protein, 448 aa, Artificial Sequence
  Description of Artificial Sequence: Synthetic polypeptide
QVQLQESGPGLVKPSETLSLTCTVSGGSISSYYWSWIRQPPGKGLEWIGYVYYSGTTNYNPSLKSRVTISVDTSKNQFSLKLSSVTAADTAVYYCASIAVTGFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVCTLPPSRDELTKNQVSLTCLVEGFYPSDIAVEWESNGQPENNYKTTPPVLDSDGSFFLYSDLTVDKSRWQQGNVFSCSVMHEALHNHYTQESLSLSPGK

SEQ ID NO: 285 - protein, 449 aa, Artificial Sequence
  Description of Artificial Sequence: Synthetic polypeptide
QVQLQQSGPVLVKPGASVKMSCKASGYSFTDYYVNWVKQSHGKSLEWIGIISPNDGGTNYNQKFKGKATLTVDKSSSTAYMEVNSLTSEDSAVYYCARDDDLGWYFDVWGTGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVCTLPPSRDELTKNQVSLTCLVEGFYPSDIAVEWESNGQPENNYKTTPPVLDSDGSFFLYSDLTVDKSRWQQGNVFSCSVMHEALHNHYTQESLSLSPGK

SEQ ID NO: 286 - protein, 448 aa, Artificial Sequence
  Description of Artificial Sequence: Synthetic polypeptide
QVQLVESGGGAVQPGRSLRLSCAASGFTFSNYGMHWVRQAPGKGLEWVAVISHHGSSKYYARSVKGRFTISRDNSKNTLYLEMNSLRAEDTAVYYCARDWWELVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVCTLPPSRDELTKNQVSLTCLVEGFYPSDIAVEWESNGQPENNYKTTPPVLDSDGSFFLYSDLTVDKSRWQQGNVFSCSVMHEALHNHYTQESLSLSPGK

SEQ ID NO: 287 - protein, 448 aa, Artificial Sequence; identical to SEQ ID NO: 286
  Description of Artificial Sequence: Synthetic polypeptide

SEQ ID NO: 288 - protein, 448 aa, Artificial Sequence
  Description of Artificial Sequence: Synthetic polypeptide
QVQLVESGGGVVQPGRSLRLSCAASGFTFSNYGMHWVRQAPGKGLEWVAVISHHGSSKYYADSVKGRFTISRDNSKNTLYLQMNSLRAEDTAVYYCARDWFFYLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVCTLPPSRDELTKNQVSLTCLVEGFYPSDIAVEWESNGQPENNYKTTPPVLDSDGSFFLYSDLTVDKSRWQQGNVFSCSVMHEALHNHYTQESLSLSPGK

SEQ ID NO: 289 - protein, 448 aa, Artificial Sequence
  Description of Artificial Sequence: Synthetic polypeptide
QVQLVESGGGVVQPGRSLRLSCAASGFTFSNYGMHWVRQAPGKGLEWVAVISHHGSSKYYADSVKGRFTISRDNSKNTLYLQMNSLRAEDTAVYYCARDWFYFIFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVCTLPPSRDELTKNQVSLTCLVEGFYPSDIAVEWESNGQPENNYKTTPPVLDSDGSFFLYSDLTVDKSRWQQGNVFSCSVMHEALHNHYTQESLSLSPGK

SEQ ID NO: 290 - protein, 447 aa, Artificial Sequence
  Description of Artificial Sequence: Synthetic polypeptide
QVQLVQSGAEVKKPGASVKVSCKASDYTFSNYYIEWVRQAPGQGLEWMGEILPGNGNTVYNEKFKDRVTMTVDTSTSTAYMELRSLRSDDTAVYYCARWGDYALFANWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVCTLPPSRDELKNQVSLTCLVEGFYPSDIAVEWESNGQPENNYKTTPPVLDSDGSFFLYSDLTVDKSRWQQGNVFSCSVMHEALHNHYTQESLSLSPGK

SEQ ID NO: 291 - protein, 452 aa, Artificial Sequence
  Description of Artificial Sequence: Synthetic polypeptide
QVQLVQSGAEVKKPGASVKVSCKASGYTFTDYFMNWVRQAPGQGLEWMGVINPYNDITIYNQKFQGRVTMTVDRSTSTVYMELSSLRSEDTAVYYCAREGVLYDGYYEGAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVCTLPPSRDELTKNQVSLTCLVEGFYPSDIAVEWESNGQPENNYKTTPPVLDSDGSFFLYSDLTVDKSRWQQGNVFSCSVMHEALHNHYTQESLSLSPGK

SEQ ID NO: 292 - protein, 448 aa, Artificial Sequence
  Description of Artificial Sequence: Synthetic polypeptide
QVQLVQSGAEVKKPGASVKVSCKATDYIFSNYYIEWVRQAPGQGLEWMGEILPGTGNTVYNEKFKDRVTMTVDTSTSTVYMELSSLRSEDTAVYYCARWGDYALFANWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVCTLPPSRDELTKNQVSLTCLVEGFYPSDIAVEWESNGQPENNYKTTPPVLDSDGSFFLYSDLTVDKSRWQQGNVFSCSVMHEALHNHYTQESLSLSPGK

SEQ ID NO: 293 - protein, 446 aa, Artificial Sequence
  Description of Artificial Sequence: Synthetic polypeptide
SDVQLQESGPGLVKPSQSLSLTCSVTGYSITSAYYWNWIRQFPGNKLEWMGYISDVGHNYYNPSLKNRISITRDTSKNQFFLKLNSVTPEDTATYYCARDQVFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVCTLPPSRDELTKNQVSLTCLVEGFYPSDIAVEWESNGQPENNYKTTPPVLDSDGSFFLYSDLTVDKSRWQQGNVFSCSVMHEALHNHYTQESLSLSPGK

SEQ ID NO: 294 - protein, 446 aa, Artificial Sequence
  Description of Artificial Sequence: Synthetic polypeptide
SDVQLQESGPGLVKPSQSLSLTCSVTGYSITSAYYWNWIRQFPGNKLEWMGYISDVGSNNYNPSLKNRISITRDTFKNQFFLKLNSVTTEDTATYFCTRDQVFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVCTLPPSRDELTKNQVSLTCLVEGFYPSDIAVEWESNGQPENNYKTTPPVLDSDGSFFLYSDLTVDKSRWQQGNVFSCSVMHEALHNHYTQESLSLSPGK

SEQ ID NO: 295 - protein, 214 aa, Artificial Sequence
  Description of Artificial Sequence: Synthetic polypeptide
DIQLTQSPSFLSASVGDRVTITCKASQNVGIAVAWYQQKPGKAPKLLIYAASNRYTGVPSRFSGSGSGTEFTLTISSLQPEDFATYYCQQYSTYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 296 - protein, 214 aa, Artificial Sequence
  Description of Artificial Sequence: Synthetic polypeptide
DIQMTQSPSFLSASVGDRVTITCKASQNVGTNVAWYQQKPGKAPKPLIYSTSYRYSGVPSRFSGSGSGTEFTLTISSLQPEDFATYYCQQYNNYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 297 - protein, 219 aa, Artificial Sequence
  Description of Artificial Sequence: Synthetic polypeptide
DIQMTQSPSSLSASVGDRVTITCKSSQSLLHSDAKTFLYWYQQKPGKAPKLLIYEVSNRFSGVPSRFSGSGSGTDFTLTISSLQPEDFATYYCLQGERLPFTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 298 - protein, 214 aa, Artificial Sequence
  Description of Artificial Sequence: Synthetic polypeptide
DIQMTQSPSTLSASVGDRVTITCKASQNVGTNVAWYQQKPGKAPKALIYSASYRYSGVPSRFSGSGSGTEFTLTISSLQPDDFATYYCQQYNSYPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 299 - protein, 219 aa, Artificial Sequence
  Description of Artificial Sequence: Synthetic polypeptide
DIVMTQAAFSNPVTVGTSASISCRSSKSLLHSNGITYLYWYLQKPGQSPQLLIYQMSNLASGVPDRFSSSGSGTDFTLRISRVEAEDVGVYYCAQNLELPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 300 - protein, 215 aa, Artificial Sequence
  Description of Artificial Sequence: Synthetic polypeptide
DIVMTQSPKFMSTSVGDRVSVTCKASQNVGTNVAWYQQKPGQSPKALIYSASYRYSGVPDRFTGSGSGTDFTLTFSSVQSEDLAEYFCQQYNNYPLTFGGGTKLEIKRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 301 - protein, 219 aa, Artificial Sequence
  Description of Artificial Sequence: Synthetic polypeptide
DIVMTQSPLSLPVTPGEPASISCKSSQSLLHSDAKTFLYWYLQKPGQSPQLLIYEVSNRFSGVPDRFSGSGSGTDFTLKISRVEAEDVGVYYCLQGRELPFTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 302 - protein, 219 aa, Artificial Sequence
  Description of Artificial Sequence: Synthetic polypeptide
DIVMTQSPLSLPVTPGEPASISCKSSQSLLHSDGKTFLYWYLQKPGQSPQLLIYEVSNRFSGVPDRFSGSGSGTDFTLKISRVEAEDVGVYYCLQGERLPFTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 303 - protein, 219 aa, Artificial Sequence
  Description of Artificial Sequence: Synthetic polypeptide
DIVMTQSPLSLPVTPGEPASISCRSSQSLLHSDAKTFLDWYLQKPGQSPQLLIYEVSNRASGVPDRFSGSGSGTDFTLKISRVEAEDVGVYYCLQGRELPFTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 304 - protein, 219 aa, Artificial Sequence
  Description of Artificial Sequence: Synthetic polypeptide
DIVMTQSPLSLPVTPGEPASISCRSSQSLLHSDGKTFLDWYLQKPGQSPQLLIYEVSNRASGVPDRFSGSGSGTDFTLKISRVEAEDVGVYYCLQGERLPFTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 305 - protein, 219 aa, Artificial Sequence
  Description of Artificial Sequence: Synthetic polypeptide
DIVMTQTPLSLSVTPGQPASISCKSSQSLLHSDAKTFLYWYLQKPGQPPQLLIYEVSNRFSGVPDRFSGSGSGTDFTLKISRVEAEDVGVYYCLQGRELPFTFGPGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 306 - protein, 231 aa, Artificial Sequence
  Description of Artificial Sequence: Synthetic polypeptide
DIVMTQTPLSLSVTPGQPASISCKSSQSLLHSDAKTFLYWYLQKPGQPPQLLIYEVSNRFSGVPDRFSGSGSGTDFTLKISRVEAEDVGVYYCLQGRELPFTFGPGTKVEIKSTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 307 - protein, 219 aa, Artificial Sequence
  Description of Artificial Sequence: Synthetic polypeptide
DIVMTQTPLSLSVTPGQPASISCKSSQSLLHSDGKTFLYWYLQKPGQPPQLLIYEVSNRFSGVPDRFSGSGSGTDFTLKISRVEAEDVGVYYCLQGERLPFTFGPGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 308 - protein, 231 aa, Artificial Sequence
  Description of Artificial Sequence: Synthetic polypeptide
DIVMTQTPLSLSVTPGQPASISCKSSQSLLHSDGKTFLYWYLQKPGQPPQLLIYEVSNRFSGVPDRFSGSGSGTDFTLKISRVEAEDVGVYYCLQGERLPFTFGPGTKVEIKSTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 309 - protein, 219 aa, Artificial Sequence
  Description of Artificial Sequence: Synthetic polypeptide
DIVMTQTPLSLSVTPGQPASISCKSSQSLLHSDGKTFLYWYLQKPGQPPQLLIYEVSNRFSGVPDRFSGSGSGTDFTLKISRVEAEDVGVYYCLQGIHLPFTFGPGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 310 - protein, 231 aa, Artificial Sequence
  Description of Artificial Sequence: Synthetic polypeptide
DIVMTQTPLSLSVTPGQPASISCKSSQSLLHSDGKTFLYWYLQKPGQPPQLLIYEVSNRFSGVPDRFSGSGSGTDFTLKISRVEAEDVGVYYCLQGIHLPFTFGPGTKVEIKSTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 311 - protein, 218 aa, Artificial Sequence
  Description of Artificial Sequence: Synthetic polypeptide
DTVLTQSPASLAVSLGQRATISCRASESVHSYGNSLIHWYQQKPGQPPRLLIYRASNLESGIPARFSGSGSRTDFTLTINPVEADDVATYYCQQTNEDPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 312 - protein, 215 aa, Artificial Sequence
  Description of Artificial Sequence: Synthetic polypeptide
EIVLTQSPGTLSLSPGERVTLSCRASQRVNNNYLAWYQQRPGQAPRLLIYGASSRATGIPDRFSGSGSGTDFTLTISRLEPEDFAVYYCQQYDRSPLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 313 - protein, 213 aa, Artificial Sequence
  Description of Artificial Sequence: Synthetic polypeptide
QIVLTQSPAIMSASPGEKVTMTCSASSSVSYMHWYQQKSGTSPKRWIYDTSKLASGVPARFSGSGSGTSYSLTISSMEAEDAATYYCQQWSSNPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 314 - protein, 1 aa, Artificial Sequence
  Description of Artificial Sequence: Synthetic peptide
G

SEQ ID NO: 315 - protein, 2 aa, Artificial Sequence
  Description of Artificial Sequence: Synthetic peptide
GS

SEQ ID NO: 316 - protein, 3 aa, Artificial Sequence
  Description of Artificial Sequence: Synthetic peptide
GSS

SEQ ID NO: 317 - protein, 5 aa, Artificial Sequence
  Description of Artificial Sequence: Synthetic peptide
GSSSG

SEQ ID NO: 318 - protein, 5 aa, Artificial Sequence
  Description of Artificial Sequence: Synthetic peptide
GGGGS

SEQ ID NO: 319 - protein, 10 aa, Artificial Sequence
  Description of Artificial Sequence: Synthetic peptide
GGGGSGGGGS

SEQ ID NO: 320 - protein, 15 aa, Artificial Sequence
  Description of Artificial Sequence: Synthetic peptide
GGGGSGGGGSGGGGS

SEQ ID NO: 321 - protein, 20 aa, Artificial Sequence
  Description of Artificial Sequence: Synthetic peptide
GGGGSGGGGSGGGGSGGGGS

SEQ ID NO: 322 - protein, 25 aa, Artificial Sequence
  Description of Artificial Sequence: Synthetic peptide
GGGGSGGGGSGGGGSGGGGSGGGGS

SEQ ID NO: 323 - protein, 7 aa, Artificial Sequence
  Description of Artificial Sequence: Synthetic peptide
PGGGGSP

SEQ ID NO: 324 - protein, 19 aa, Artificial Sequence
  Description of Artificial Sequence: Synthetic peptide
PGGGGSPGGGGSPGGGGSP

SEQ ID NO: 325 - protein, 7 aa, Artificial Sequence
  Description of Artificial Sequence: Synthetic peptide
GEPGSGE

SEQ ID NO: 326 - protein, 14 aa, Artificial Sequence
  Description of Artificial Sequence: Synthetic peptide
GEPGSGEGEPGSGE

SEQ ID NO: 327 - protein, 22 aa, Artificial Sequence
  Description of Artificial Sequence: Synthetic peptide
GEPGSGEGEPGSGEEGEPGSGE

SEQ ID NO: 328 - protein, 32 aa, Artificial Sequence
  Description of Artificial Sequence: Synthetic polypeptide
EGEPGSGEEGEPGSGEEGEPGSGEEGEPGSGE

SEQ ID NO: 329 - protein, 5 aa, Artificial Sequence
  Description of Artificial Sequence: Synthetic peptide
GKPGS

SEQ ID NO: 330 - protein, 10 aa, Artificial Sequence
  Description of Artificial Sequence: Synthetic peptide
GKPGSGKPGS

SEQ ID NO: 331 - protein, 15 aa, Artificial Sequence
  Description of Artificial Sequence: Synthetic peptide
GKPGSGKPGSGKPGS

SEQ ID NO: 332 - protein, 20 aa, Artificial Sequence
  Description of Artificial Sequence: Synthetic peptide
GKPGSGKPGSGKPGSGKPGS

SEQ ID NO: 333 - protein, 25 aa, Artificial Sequence
  Description of Artificial Sequence: Synthetic peptide
GKPGSGKPGSGKPGSGKPGSGKPGS

SEQ ID NO: 334 - protein, 5 aa, Artificial Sequence
  Description of Artificial Sequence: Synthetic peptide
SSSSG

SEQ ID NO: 335 - protein, 10 aa, Artificial Sequence
  Description of Artificial Sequence: Synthetic peptide
SSSSGSSSSG

SEQ ID NO: 336 - protein, 15 aa, Artificial Sequence
  Description of Artificial Sequence: Synthetic peptide
SSSSGSSSSGSSSSG

SEQ ID NO: 337 - protein, 20 aa, Artificial Sequence
  Description of Artificial Sequence: Synthetic peptide
SSSSGSSSSGSSSSGSSSSG

SEQ ID NO: 338 - protein, 19 aa, Artificial Sequence
  Description of Artificial Sequence: Synthetic peptide
GRPGSGPGSGRPGSGRPGS

SEQ ID NO: 339 - protein, 24 aa, Artificial Sequence
  Description of Artificial Sequence: Synthetic peptide
GRPGSGPGSGRPGSGRPGSGRGPS

SEQ ID NO: 340 - protein, 20 aa, Artificial Sequence
  Description of Artificial Sequence: Synthetic peptide
GKPGSGRPGSGKGPSGRPGS

SEQ ID NO: 341 - protein, 731 aa, Artificial Sequence
  Description of Artificial Sequence: Synthetic polypeptide
QVQLVQSGAEVKKPGASVKVSCKASDYTFSNYYIEWVRQAPGQGLEWMGEILPGNGNTVYNEKFKDRVTMTVDTSTSTAYMELRSLRSDDTAVYYCARWGDYALFANWGQGTLVTVSSGGGGSGGGGSGGGGSDIQMTQSPSTLSASVGDRVTITCKASQNVGTNVAWYQQKPGKAPKALIYSASYRYSGVPSRFSGSGSGTEFTLTISSLQPDDFATYYCQQYNSYPFTFGQGTKLEIKSGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 342 - protein, 731 aa, Artificial Sequence
  Description of Artificial Sequence: Synthetic polypeptide
QVQLVQSGAEVKKPGASVKVSCKATDYIFSNYYIEWVRQAPGQGLEWMGEILPGTGNTVYNEKFKDRVTMTVDTSTSTVYMELSSLRSEDTAVYYCARWGDYALFANWGQGTLVTVSSGGGGSGGGGSGGGGSDIQMTQSPSTLSASVGDRVTITCKASQNVGTNVAWYQQKPGKAPKALIYSASYRYSGVPSRFSGSGSGTEFTLTISSLQPDDFATYYCQQYNSYPFTFGQGTKLEIKSGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 343 - protein, 735 aa, Artificial Sequence
  Description of Artificial Sequence: Synthetic polypeptide
QVQLVQSGAEVKKPGASVKVSCKASGYTFTDYFMNWVRQAPGQGLEWMGVINPYNDITIYNQKFQGRVTMTVDRSTSTVYMELSSLRSEDTAVYYCAREGVLYDGYYEGAYWGQGTLVTVSSGGGGSGGGGSGGGGSDIQLTQSPSFLSASVGDRVTITCKASQNVGIAVAWYQQKPGKAPKLLIYAASNRYTGVPSRFSGSGSGTEFTLTISSLQPEDFATYYCQQYSTYPYTFGQGTKLEIKSGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 344 - protein, 735 aa, Artificial Sequence
  Description of Artificial Sequence: Synthetic polypeptide
QVQLVQSGAEVKKPGASVKVSCKASGYTFTDYFMNWVRQAPGQCLEWMGVINPYNDITIYNQKFQGRVTMTVDRSTSTVYMELSSLRSEDTAVYYCAREGVLYDGYYEGAYWGQGTLVTVSSGGGGSGGGGSGGGGSDIQLTQSPSFLSASVGDRVTITCKASQNVGIAVAWYQQKPGKAPKLLIYAASNRYTGVPSRFSGSGSGTEFTLTISSLQPEDFATYYCQQYSTYPYTFGCGTKLEIKSGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFEYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 345 - protein, 731 aa, Artificial Sequence
  Description of Artificial Sequence: Synthetic polypeptide
QVQLVQSGAEVKKPGASVKVSCKATDYIFSNYYIEWVRQAPGQGLEWMGEILPGTGNTVYNEKFKDRVTMTVDTSTSTVYMELSSLRSEDTAVYYCARWGDYALFANWGQGTLVTVSSGGGGSGGGGSGGGGSDIQMTQSPSFLSASVGDRVTITCKASQNVGTNVAWYQQKPGKAPKPLIYSTSYRYSGVPSRFSGSGSGTEFTLTISSLQPEDFATYYCQQYNNYPLTFGGGTKVEIKSGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 346 - protein, 735 aa, Artificial Sequence; identical to SEQ ID NO: 343
  Description of Artificial Sequence: Synthetic polypeptide

SEQ ID NO: 347 - protein, 735 aa, Artificial Sequence
  Description of Artificial Sequence: Synthetic polypeptide
QVQLVQSGAEVKKPGASVKVSCKASGYTFTDYFMNWVRQAPGQGLEWMGVINPYNDITIYNQKFQGRVTMTVDRSTSTVYMELSSLRSEDTAVYYCAREGVLYDGYYEGAYWGQGTLVTVSSGGGGSGGGGSGGGGSDIQLTQSPSFLSASVGDRVTITCKASQNVGIAVAWYQQKPGKAPKLLIYAASNRYTGVPSRFSGSGSGTEFTLTISSLQPEDFATYYCQQYSTYPYTFGQGTKLEIKSGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFEYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 348 - protein, 735 aa, Artificial Sequence
  Description of Artificial Sequence: Synthetic polypeptide
QVQLVQSGAEVKKPGASVKVSCKASGYTFTDYFMNWVRQAPGQGLEWMGVINPYNDITIYNQKFQGRVTMTVDRSTSTVYMELSSLRSEDTAVYYCAREGVLYDGYYEGAYWGQGTLVTVSSGGGGSGGGGSGGGGSDIQLTQSPSFLSASVGDRVTITCKASQNVGIAVAWYQQKPGKAPKLLIYAASNRYTGVPSRFSGSGSGTEFTLTISSLQPEDFATYYCQQYSTYPYTFGQGTKLEIKSGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFNYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 349 - protein, 733 aa, Artificial Sequence
  Description of Artificial Sequence: Synthetic polypeptide
EVQLVQSGAEVKKPGESLKISCKGSGYEFSSHWMNWVRQMPGKCLEWMGQIYPGDGDINYNEKFRGQVTISADKSISTAYLQWSSLKASDTAMYYCARHGNYVMDYWGQGTLVTVSSGGGGSGGGGSGGGGSGGGGSIQLTQSPSFLSASVGDRVTITCSASSSVSYMFWYQQKPGKAPKPWIYRTSNLASGVPSRFSGSGSGTEFTLTISSLQPEDFATYYCQQFHDYPRTFGCGTKVEIKSGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFEYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 350 - protein, 733 aa, Artificial Sequence
  Description of Artificial Sequence: Synthetic polypeptide
EVQLVQSGAEVKKPGESLKISCKGSGYEFSSHWMNWVRQMPGKGLEWMGQIYPGDGDINYNEKFRGQVTISADKSISTAYLQWSSLKASDTAMYYCARHGNYVMDYWGQGTLVTVSSGGGGSGGGGSGGGGSGGGGSIQLTQSPSFLSASVGDRVTITCSASSSVSYMFWYQQKPGKAPKPWIYRTSNLASGVPSRFSGSGSGTEFTLTISSLQPEDFATYYCQQFHDYPRTFGGGTKVEIKSGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 351 - protein, 984 aa, Artificial Sequence
  Description of Artificial Sequence: Synthetic polypeptide
QVQLQQWGAGLLKPSETLSLTCAVYGGSFSGYYWSWIRQPPGKCLEWIGDIDASGSTKYNPSLKSRVTISLDTSKNQFSLKLNSVTAADTAVYFCARKKYSTVWSYFDNWGQGTLVTVSSGGGGSGGGGSGGGGSSYELTQPSSVSVPPGQTASITCSGDKLGDKYASWYQQKPGQSPVLVIYQDRKRPSGVPERFSGSNSGNTATLTISGTQAMDEADYYCQAWGSSTAVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 352 - protein, 985 aa, Artificial Sequence
  Description of Artificial Sequence: Synthetic polypeptide
QVQLVESGGGVVQPGRSLRLSCAASGFTFSNHGMHWVRQAPGKCLEWVAGIWSEGSNKYYADAVKGRFTISRDNSKNTLYLQMNSLRAEDTAVYYCARATYTTGWSYFDYWGQGTLVTVSSGGGGSGGGGSGGGGSSYELTQPPSVSVSPGQTASITCSGDKLGDKYASWYQQKSGQSPVLVIYQDAKRPSGIPERFSGSNSGNTATLTISGTQAMDEADYYCQAFHQSTWVFGCGTQLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 353 - protein, 738 aa, Artificial Sequence
  Description of Artificial Sequence: Synthetic polypeptide
QVQLVQSGAEVKKPGSSVKVSCKASGYTFTSYWLNWVRQAPGQGLEWMGMIHPSDSESRLNQKFKDRVTITADKSTSTAYMELSSLRSEDTAVYYCARQGIITSVQEFAYWGQGTLVTVSSGGGGSGGGGSGGGGSGGGGSIQMTQSPSSLSASVGDRVTITCSASSSVNYIFWYQQKPGKAPKLLIYRTSNLASGVPSRFSGSGSGTDFTLTISSLQPEDFATYYCQQYHSYPLTFGGGTKVEIKSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFEYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 354 - protein, 737 aa, Artificial Sequence
  Description of Artificial Sequence: Synthetic polypeptide
QVQLVQSGAEVKKPGSSVKVSCKASGYTFTSYWLNWVRQAPGQGLEWMGMIHPSDSESRLNQKFKDRVTITADKSTSTAYMELSSLRSEDTAVYYCARQGIITSVQEFAYWGQGTLVTVSSGGGGSGGGGSGGGGSGGGGSIQMTQSPSSLSASVGDRVTITCSASSSVNYIFWYQQKPGKAPKLLIYRTSNLASGVPSRFSGSGSGTDFTLTISSLQPEDFATYYCQQYHSYPLTFGGGTKVEIKSGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFEYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 355 - protein, 738 aa, Artificial Sequence
  Description of Artificial Sequence: Synthetic polypeptide
QVQLVQSGAEVKKPGSSVKVSCKASGYTFTSYWLNWVRQAPGQGLEWMGMIHPSDSESRLNQKFKDRVTITADKSTSTAYMELSSLRSEDTAVYYCARQGIITSVQEFAYWGQGTLVTVSSGGGGSGGGGSGGGGSGGGGSIQMTQSPSSLSASVGDRVTITCSASSSVNYIYWYQQKPGKAPKLLIYRTSNLASGVPSRFSGSGSGTDFTLTISSLQPEDFATYYCQQYHSYPLTFGGGTKVEIKSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFEYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 356 - protein, 738 aa, Artificial Sequence
  Description of Artificial Sequence: Synthetic polypeptide
QVQLVQSGAEVKKPGSSVKVSCKASGYTFTSYWLNWVRQAPGQGLEWMGMIHPSDSETRLNQKFKDRVTITADKSTSTAYMELSSLRSEDTAVYYCARQGIITSVQEFAYWGQGTLVTVSSGGGGSGGGGSGGGGSGGGGSIQMTQSPSSLSASVGDRVTITCSASSSVNYIFWYQQKPGKAPKLLIYRTSNLASGVPSRFSGSGSGTDFTLTISSLQPEDFATYYCQQYHSYPLTFGGGTKVEIKSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFEYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 357 - protein, 738 aa, Artificial Sequence
  Description of Artificial Sequence: Synthetic polypeptide
QVQLVQSGAEVKKPGSSVKVSCKASGYTFTSYWLNWVRQAPGQGLEWMGMIHPSDSETRLNQKFKDRVTITADKSTSTAYMELSSLRSEDTAVYYCARQGIITSVQEFAYWGQGTLVTVSSGGGGSGGGGSGGGGSGGGGSIQMTQSPSSLSASVGDRVTITCSASSSVNYIYWYQQKPGKAPKLLIYRTSNLASGVPSRFSGSGSGTDFTLTISSLQPEDFATYYCQQYHSYPLTFGGGTKVEIKSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFEYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 358 - protein, 737 aa, Artificial Sequence
  Description of Artificial Sequence: Synthetic polypeptide
QVQLVQSGAEVKKPGSSVKVSCKASGYTFTSYWMNWVRQAPGQGLEWMGMIHPSDSESRLNQKFKDRVTITADKSTSTAYMELSSLRSEDTAVYYCARQGIITSVQEFAYWGQGTLVTVSSGGGGSGGGGSGGGGSGGGGSIQMTQSPSSLSASVGDRVTITCSASSSVNYIFWYQQKPGKAPKLLIYRTSNLASGVPSRFSGSGSGTDFTLTISSLQPEDFATYYCQQYHSYPLTFGGGTKVEIKSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFEYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPG

SEQ ID NO: 359 - protein, 738 aa, Artificial Sequence
  Description of Artificial Sequence: Synthetic polypeptide
QVQLVQSGAEVKKPGSSVKVSCKASGYTFTSYWMNWVRQAPGQGLEWMGMIHPSDSESRLNQKFKDRVTITADKSTSTAYMELSSLRSEDTAVYYCARQGIITSVQEFAYWGQGTLVTVSSGGGGSGGGGSGGGGSGGGGSIQMTQSPSSLSASVGDRVTITCSASSSVNYIYWYQQKPGKAPKLLIYRTSNLASGVPSRFSGSGSGTDFTLTISSLQPEDFATYYCQQYHSYPLTFGGGTKVEIKSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFEYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 360 - protein, 738 aa, Artificial Sequence
  Description of Artificial Sequence: Synthetic polypeptide
QVQLVQSGAEVKKPGSSVKVSCKASGYTFTSYWMNWVRQAPGQGLEWMGMIHPSDSETRLNQKFKDRVTITADKSTSTAYMELSSLRSEDTAVYYCARQGIITSVQEFAYWGQGTLVTVSSGGGGSGGGGSGGGGSGGGGSIQMTQSPSSLSASVGDRVTITCSASSSVNYIFWYQQKPGKAPKLLIYRTSNLASGVPSRFSGSGSGTDFTLTISSLQPEDFATYYCQQYHSYPLTFGGGTKVEIKSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFEYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 361 - protein, 737 aa, Artificial Sequence
  Description of Artificial Sequence: Synthetic polypeptide
QVQLVQSGAEVKKPGSSVKVSCKASGYTFTSYWMNWVRQAPGQGLEWMGMIHPSDSETRLNQKFKDRVTITADKSTSTAYMELSSLRSEDTAVYYCARQGIITSVQEFAYWGQGTLVTVSSGGGGSGGGGSGGGGSGGGGSIQMTQSPSSLSASVGDRVTITCSASSSVNYIYWYQQKPGKAPKLLIYRTSNLASGVPSRFSGSGSGTDFTLTISSLQPEDFATYYCQQYHSYPLTFGGGTKVEIKSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFEYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPG

SEQ ID NO: 362 - protein, 737 aa, Artificial Sequence
  Description of Artificial Sequence: Synthetic polypeptide
QVQLVQSGAEVKKPGSSVKVSCKASGYTFTSYWMNWVRQAPGQGLEWMGMIHPSDSETRLNQKFKDRVTITADKSTSTAYMELSSLRSEDTAVYYCARQGIITSVQEFAYWGQGTLVTVSSGGGGSGGGGSGGGGSGGGGSIQMTQSPSSLSASVGDRVTITCSASSSVNYIYWYQQKPGKAPKLLIYRTSNLASGVPSRFSGSGSGTDFTLTISSLQPEDFATYYCQQYHSYPLTFGGGTKVEIKSGGGSEVQLVESGGGLVQPGGSLRLSCAASGFTFSTYAMNWVRQAPGKGLEWVGRIRSKINNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 363 - protein, 737 aa, Artificial Sequence
  Description of Artificial Sequence: Synthetic polypeptide
QVQLVQSGAEVKKPGSSVKVSCKASGYTFTSYWMNWVRQAPGQGLEWMGMIHPSDSETRLNQKFKDRVTITADKSTSTAYMELSSLRSEDTAVYYCARQGIITSVQEFAYWGQGTLVTVSSGGGGSGGGGSGGGGSGGGGSIQMTQSPSSLSASVGDRVTITCSASSSVNYIYWYQQKPGKAPKLLIYRTSNLASGVPSRFSGSGSGTDFTLTISSLQPEDFATYYCQQYHSYPLTFGGGTKVEIKSGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 364 - protein, 737 aa, Artificial Sequence
  Description of Artificial Sequence: Synthetic polypeptide
QVQLVQSGAEVKKPGSSVKVSCKASGYTFTSYWMNWVRQAPGQGLEWMGMIHPSDSETRLNQKFKDRVTITADKSTSTAYMELSSLRSEDTAVYYCARQGIITSVQEFAYWGQGTLVTVSSGGGGSGGGGSGGGGSGGGGSIQMTQSPSSLSASVGDRVTITCSASSSVNYIYWYQQKPGKAPKLLIYRTSNLASGVPSRFSGSGSGTDFTLTISSLQPEDFATYYCQQYHSYPLTFGGGTKVEIKSGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFEYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 365 - protein, 737 aa, Artificial Sequence
  Description of Artificial Sequence: Synthetic polypeptide
QVQLVQSGAEVKKPGSSVKVSCKASGYTFTSYWMNWVRQAPGQGLEWMGMIHPSDSETRLNQKFKDRVTITADKSTSTAYMELSSLRSEDTAVYYCARQGIITSVQEFNYWGQGTLVTVSSGGGGSGGGGSGGGGSGGGGSIQMTQSPSSLSASVGDRVTITCSASSSVNYIYWYQQKPGKAPKLLIYRTSNLASGVPSRFSGSGSGTDFTLTISSLQPEDFATYYCQQYHSYPLTFGGGTKVEIKSGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 366 - protein, 474 aa, Artificial Sequence
  Description of Artificial Sequence: Synthetic polypeptide
EVQLVQSGAEVKKPGESLKISCKGSGYEFSSHWMNWVRQMPGKGLEWMGQIYPGDGDINYNEKFRGQVTISADKSISTAYLQWSSLKASDTAMYYCARHGNYVMDYWGQGTLVTVSSGKPGSGKPGSGKPGSGKPGSIQLTQSPSFLSASVGDRVTITCSASSSVSYMFWYQQKPGKAPKPWIYRTSNLASGVPSRFSGSGSGTEFTLTISSLQPEDFATYYCQQFHDYPRTFGGGTKVEIKEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 367 - protein, 478 aa, Artificial Sequence
  Description of Artificial Sequence: Synthetic polypeptide
QVQLVQSGAEVKKPGSSVKVSCKASGYTFTSYWMNWVRQAPGQGLEWMGMIHPSDSETRLNQKFKDRVTITADKSTSTAYMELSSLRSEDTAVYYCARQGIITSVQEFAYWGQGTLVTVSSGKPGSGKPGSGKPGSGKPGSIQMTQSPSSLSASVGDRVTITCSASSSVNYIYWYQQKPGKAPKLLIYRTSNLASGVPSRFSGSGSGTDFTLTISSLQPEDFATYYCQQYHSYPLTFGGGTKVEIKEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 368 - protein, 450 aa, Artificial Sequence
  Description of Artificial Sequence: Synthetic polypeptide
EVQLVESGGGLVQPGGSLRLSCAASGFTFSSFGMHWVRQAPGKGLEWVSYISSGSSTIYYADTVKGRFTISRDNAKNSLYLQMNSLRAEDTAVYYCARWGYYGSSYFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVCTLPPSRDELTKNQVSLTCLVEGFYPSDIAVEWESNGQPENNYKTTPPVLDSDGSFFLYSDLTVDKSRWQQGNVFSCSVMHEALHNHYTQESLSLSPGK

SEQ ID NO: 369 - protein, 447 aa, Artificial Sequence
  Description of Artificial Sequence: Synthetic polypeptide
EVQLVQSGAEVKKPGESLKISCKGSGYEFSSHWMNWVRQMPGKGLEWMGQIYPGDGDINYNEKFRGQVTISADKSISTAYLQWSSLKASDTAMYYCARHGNYVMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVCTLPPSRDELTKNQVSLTCLVEGFYPSDIAVEWESNGQPENNYKTTPPVLDSDGSFFLYSDLTVDKSRWQQGNVFSCSVMHEALHNHYTQESLSLSPGK

SEQ ID NO: 370 - protein, 447 aa, Artificial Sequence
  Description of Artificial Sequence: Synthetic polypeptide
QVQLVQSGAEVKKPGASVKVSCKASGYEFSSHWMNWVRQAPGQGLEWMGQIYPGDGDINYNEKFRGRVTMTRDTSTSTVYMELSSLRSEDTAVYYCARHGNYVMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVCTLPPSRDELTKNQVSLTCLVEGFYPSDIAVEWESNGQPENNYKTTPPVLDSDGSFFLYSDLTVDKSRWQQGNVFSCSVMHEALHNHYTQESLSLSPGK

SEQ ID NO: 371 - protein, 451 aa, Artificial Sequence
  Description of Artificial Sequence: Synthetic polypeptide
QVQLVQSGAEVKKPGASVKVSCKASGYTFTSYWMNWVRQAPGQGLEWIGMIHPSDSETRLNQKFKDRVTLTVDKSSSTAYMELSSLRSEDTAVYYCARQGIITSVQEFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVCTLPPSRDELTKNQVSLTCLVEGFYPSDIAVEWESNGQPENNYKTTPPVLDSDGSFFLYSDLTVDKSRWQQGNVFSCSVMHEALHNHYTQESLSLSPGK

SEQ ID NO: 372 - protein, 451 aa, Artificial Sequence
  Description of Artificial Sequence: Synthetic polypeptide
QVQLVQSGAEVKKPGASVKVSCKASGYTFTSYWMNWVRQAPGQGLEWMGMIHPSDSETRLNQEFKDRVTMTRDTSTSTVYMELSSLRSEDTAVYYCARQGVITSVQEFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVCTLPPSRDELTKNQVSLTCLVEGFYPSDIAVEWESNGQPENNYKTTPPVLDSDGSFFLYSDLTVDKSRWQQGNVFSCSVMHEALHNHYTQESLSLSPGK

SEQ ID NO: 373 - protein, 451 aa, Artificial Sequence
  Description of Artificial Sequence: Synthetic polypeptide
QVQLVQSGAEVKKPGASVKVSCKASGYTFTSYWMNWVRQAPGQGLEWMGMIHPSDSETRLNQKFKDRVTLTRDKSISTAYMELSRLRSDDTAVYYCARQGIITSVQEFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVCTLPPSRDELTKNQVSLTCLVEGFYPSDIAVEWESNGQPENNYKTTPPVLDSDGSFFLYSDLTVDKSRWQQGNVFSCSVMHEALHNHYTQESLSLSPGK

SEQ ID NO: 374 - protein, 451 aa, Artificial Sequence
  Description of Artificial Sequence: Synthetic polypeptide
QVQLVQSGAEVKKPGASVKVSCKASGYTFTSYWMNWVRQAPGQGLEWMGMIHPSDSETRLNQKFKDRVTLTVDKSISTAYMELSRLRSDDTAVYYCARQGIITSVQEFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVCTLPPSRDELTKNQVSLTCLVEGFYPSDIAVEWESNGQPENNYKTTPPVLDSDGSFFLYSDLTVDKSRWQQGNVFSCSVMHEALHNHYTQESLSLSPGK

SEQ ID NO: 375 - protein, 451 aa, Artificial Sequence
  Description of Artificial Sequence: Synthetic polypeptide
QVQLVQSGAEVKKPGASVKVSCKASGYTFTSYWMNWVRQAPGQGLEWMGMIHPSDSETRLNQKFKDRVTLTVDTSISTAYMELSRLRSDDTAVYYCARQGIITSVQEFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVCTLPPSRDELTKNQVSLTCLVEGFYPSDIAVEWESNGQPENNYKTTPPVLDSDGSFFLYSDLTVDKSRWQQGNVFSCSVMHEALHNHYTQESLSLSPGK

SEQ ID NO: 376 - protein, 451 aa, Artificial Sequence
  Description of Artificial Sequence: Synthetic polypeptide
QVQLVQSGAEVKKPGASVKVSCKASGYTFTSYWMNWVRQAPGQGLEWMGMIHPSDSETRLNQKFKDRVTMTRDTSISTAYMELSRLRSDDTAVYYCARQGIITSVQEFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVCTLPPSRDELTKNQVSLTCLVEGFYPSDIAVEWESNGQPENNYKTTPPVLDSDGSFFLYSDLTVDKSRWQQGNVFSCSVMHEALHNHYTQESLSLSPGK

SEQ ID NO: 377 - protein, 451 aa, Artificial Sequence
  Description of Artificial Sequence: Synthetic polypeptide
QVQLVQSGAEVKKPGASVKVSCKASGYTFTSYWMNWVRQAPGQGLEWMGMIHPSDSETRLNQKFKDRVTMTRDTSTSTVYMELSSLRSEDTAVYYCARQGIITSVQEFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVCTLPPSRDELTKNQVSLTCLVEGFYPSDIAVEWESNGQPENNYKTTPPVLDSDGSFFLYSDLTVDKSRWQQGNVFSCSVMHEALHNHYTQESLSLSPGK

SEQ ID NO: 378 - protein, 451 aa, Artificial Sequence
  Description of Artificial Sequence: Synthetic polypeptide
QVQLVQSGAEVKKPGASVKVSCKASGYTFTSYWMNWVRQAPGQGLEWMGMIHPSDSETRLNQKFKDRVTMTVDKSISTAYMELSRLRSDDTAVYYCARQGIITSVQEFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVCTLPPSRDELTKNQVSLTCLVEGFYPSDIAVEWESNGQPENNYKTTPPVLDSDGSFFLYSDLTVDKSRWQQGNVFSCSVMHEALHNHYTQESLSLSPGK

SEQ ID NO: 379 - protein, 447 aa, Artificial Sequence
  Description of Artificial Sequence: Synthetic polypeptide
QVQLVQSGAEVKKPGSSVKVSCKASGYEFSSHWMNWVRQAPGQGLEWMGQIYPGDGDINYNEKFRGRVTITADKSTSTAYMELSSLRSEDTAVYYCARHGNYVMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVCTLPPSRDELTKNQVSLTCLVEGFYPSDIAVEWESNGQPENNYKTTPPVLDSDGSFFLYSDLTVDKSRWQQGNVFSCSVMHEALHNHYTQESLSLSPGK

SEQ ID NO: 380 - protein, 451 aa, Artificial Sequence
  Description of Artificial Sequence: Synthetic polypeptide
QVQLVQSGAEVKKPGSSVKVSCKASGYTFTSYWMNWVRQAPGQGLEWMGMIHPSDSETRLNQKFKDRVTITADKSTSTAYMELSSLRSEDTAVYYCARQGIITSVQEFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVCTLPPSRDELTKNQVSLTCLVEGFYPSDIAVEWESNGQPENNYKTTPPVLDSDGSFFLYSDLTVDKSRWQQGNVFSCSVMHEALHNHYTQESLSLSPGK

SEQ ID NO: 381 - protein, 214 aa, Artificial Sequence
  Description of Artificial Sequence: Synthetic polypeptide
DIQMTQSPSSLSASVGDRVTITCKASEDIYNRLAWYQQKPGKAPKLLIYGATNLETGVPSRFSGSGSGKDYTLTISSLQPEDIATYYCQQFWRTPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 382 - protein, 214 aa, Artificial Sequence
  Description of Artificial Sequence: Synthetic polypeptide
DIQMTQSPSSLSASVGDRVTITCKASEDIYNRLAWYQQKPGKAPKLLIYGATNLETGVPSRFSGSGSGTDFTFTISSLQPEDIATYYCQQFWRTPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 383 - protein, 214 aa, Artificial Sequence
  Description of Artificial Sequence: Synthetic polypeptide
DIQMTQSPSSLSASVGDRVTITCKASEDIYNRLAWYQQKPGKAPKPLISGATNLETGVPSRFSGSGSGKDYTLTISSLQPEDIATYYCQQFWRTPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 384 - protein, 214 aa, Artificial Sequence
  Description of Artificial Sequence: Synthetic polypeptide
DIQMTQSPSSLSASVGDRVTITCKASEDIYNRLAWYQQKPGKAPKPLISGATNLETGVPSRFSGSGSGTDFTFTISSLQPEDIATYYCQQFWRTPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 385 - protein, 214 aa, Artificial Sequence
  Description of Artificial Sequence: Synthetic polypeptide
DIQMTQSPSSLSASVGDRVTITCKASEDIYNRLAWYQQKPGKAPKPLIYGATNLETGVPSRFSGSGSGTDFTFTISSLQPEDIATYYCQQFWRTPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 386 - protein, 213 aa, Artificial Sequence
  Description of Artificial Sequence: Synthetic polypeptide
EIVLTQSPATLSLSPGERATLSCSASSSVNYIYWYQQKPGQAPRLLIYRTSNLASGIPARFSGSGSGTDFTLTISSLEPEDFAVYYCQQYHSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 387 - protein, 213 aa, Artificial Sequence
  Description of Artificial Sequence: Synthetic polypeptide
EIVLTQSPATLSLSPGERATLSCSASSSVSYMFWYQQKPGQAPRLLIYRTSNLASGIPARFSGSGSGTDFTLTISSLEPEDFAVYYCQQFHDYPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 388 - protein, 213 aa, Artificial Sequence
  Description of Artificial Sequence: Synthetic polypeptide
EIVLTQSPATLSLSPGERATLSCSASSSVSYMFWYQQKPGQAPRPWIYRTSNLASGIPPRFSGSGSGTDYTLTISSLEPEDFAVYYCQQFHDYPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 389 - protein, 213 aa, Artificial Sequence
  Description of Artificial Sequence: Synthetic polypeptide
EIVLTQSPATLSVSPGERATLSCSASSSVNYIYWYQQKPGQAPRPWIYRTSNLASGIPARFSGSGSGTEYTLTISSLQSEDFAVYYCQQYHSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 390 - protein, 213 aa, Artificial Sequence
  Description of Artificial Sequence: Synthetic polypeptide
EIVMTQSPATLSVSPGERATLSCSASSSVNYIYWYQQKPGQAPRLLIYRTSNLASGIPARFSGSGSGTEFTLTISSLQSEDFAVYYCQQYHSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 391 - protein, 213 aa, Artificial Sequence
  Description of Artificial Sequence: Synthetic polypeptide
EIVMTQSPATLSVSPGERATLSCSASSSVSYMFWYQQKPGQAPRLLIYRTSNLASGIPARFSGSGSGTEFTLTISSLQSEDFAVYYCQQFHDYPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 392 - protein, 212 aa, Artificial Sequence
  Description of Artificial Sequence: Synthetic polypeptide
IQLTQSPSFLSASVGDRVTITCSASSSVSYMFWYQQKPGKAPKLLIYRTSNLASGVPPRFSGSGSGTEFTLTISSLQPEDFATYYCQQFHDYPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 393 - protein, 212 aa, Artificial Sequence
  Description of Artificial Sequence: Synthetic polypeptide
IQLTQSPSFLSASVGDRVTITCSASSSVSYMFWYQQKPGKAPKLLIYRTSNLASGVPPRFSGSGSGTEYTLTISSLQPEDFATYYCQQFHDYPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 394 - protein, 212 aa, Artificial Sequence
  Description of Artificial Sequence: Synthetic polypeptide
IQLTQSPSFLSASVGDRVTITCSASSSVSYMFWYQQKPGKAPKLLIYRTSNLASGVPSRFSGSGSGTEFTLTISSLQPEDFATYYCQQFHDYPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 395 - protein, 212 aa, Artificial Sequence
  Description of Artificial Sequence: Synthetic polypeptide
IQLTQSPSFLSASVGDRVTITCSASSSVSYMFWYQQKPGKAPKLLIYRTSNLASGVPSRFSGSGSGTEFTLTISSLQPEDFATYYCQQFHQYPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 396 - protein, 212 aa, Artificial Sequence
  Description of Artificial Sequence: Synthetic polypeptide
IQLTQSPSFLSASVGDRVTITCSASSSVSYMFWYQQKPGKAPKLLIYRTSNLASGVPSRFSGSGSGTEYTLTISSLQPEDFATYYCQQFHDYPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 397 - protein, 212 aa, Artificial Sequence
  Description of Artificial Sequence: Synthetic polypeptide
IQLTQSPSFLSASVGDRVTITCSASSSVSYMFWYQQKPGKAPKPWIYRTSNLASGVPPRFSGSGSGTEYTLTISSLQPEDFATYYCQQFHDYPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 398 - protein, 212 aa, Artificial Sequence
  Description of Artificial Sequence: Synthetic polypeptide
IQLTQSPSFLSASVGDRVTITCSASSSVSYMFWYQQKPGKAPKPWIYRTSNLASGVPSRFSGSGSGTEFTLTISSLQPEDFATYYCQQFHDYPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 399 - protein, 212 aa, Artificial Sequence
  Description of Artificial Sequence: Synthetic polypeptide
IQMTQSPSSLSASVGDRVTITCSASSSVNYIYWYQQKPGKAPKLLIYRTSNLASGVPSRFSGSGSGTDFTLTISSLQPEDFATYYCQQYHSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 400 - protein, 216 aa, Artificial Sequence
  Description of Artificial Sequence: Synthetic polypeptide
QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 401 - protein, 448 aa, Artificial Sequence
  Description of Artificial Sequence: Synthetic polypeptide
EVQLVESGGGLVQPGGSLRLSCAASGFTFSSFGMHWVRQAPGKGLEWVAYISSGNSAIYYADTVNGRFTISRDNPKNTLYLQMNSLRAEDTAVYYCARLRYGNSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVCTLPPSRDELTKNQVSLTCLVEGFYPSDIAVEWESNGQPENNYKTTPPVLDSDGSFFLYSDLTVDKSRWQQGNVFSCSVMHEALHNHYTQESLSLSPGK

SEQ ID NO: 402 - protein, 448 aa, Artificial Sequence
  Description of Artificial Sequence: Synthetic polypeptide
EVQLVESGGGLVQPGGSLRLSCAASGFTFSSFGMHWVRQAPGKGLEWVSYISSGNSAIYYADTVNGRFTISRDNAKNSLYLQMNSLRAEDTAVYYCARLRYGNSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVCTLPPSRDELTKNQVSLTCLVEGFYPSDIAVEWESNGQPENNYKTTPPVLDSDGSFFLYSDLTVDKSRWQQGNVFSCSVMHEALHNHYTQESLSLSPGK

SEQ ID NO: 403 - protein, 448 aa, Artificial Sequence
  Description of Artificial Sequence: Synthetic polypeptide
QIQLVQSGAEVKKPGASVKVSCKASGYTFTNSGMNWVRQAPGQGLEWMGWINTNTGEPTFAEEFRGRVTFTLDTSASTAYMELSRLRSDDTAVYYCARYYYGNSFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVCTLPPSRDELTKNQVSLTCLVEGFYPSDIAVEWESNGQPENNYKTTPPVLDSDGSFFLYSDLTVDKSRWQQGNVFSCSVMHEALHNHYTQESLSLSPGK

SEQ ID NO: 404 - protein, 451 aa, Artificial Sequence
  Description of Artificial Sequence: Synthetic polypeptide
QVQLVQSGAEVKKPGASVKVSCKASGYTFTNFGITWVRQAPGQGLEWIGEIYPSSGNTFYNEKFKGRVTLTADKSSSAAYMELRSLRSDDTAVYYCARGGGPLRSRYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVCTLPPSRDELTKNQVSLTCLVEGFYPSDIAVEWESNGQPENNYKTTPPVLDSDGSFFLYSDLTVDKSRWQQGNVFSCSVMHEALHNHYTQESLSLSPGK

SEQ ID NO: 405 - protein, 451 aa, Artificial Sequence
  Description of Artificial Sequence: Synthetic polypeptide
QVQLVQSGAEVKKPGASVKVSCKASGYTFTNFGITWVRQAPGQGLEWMGEIYPSSGNTFYNEKFKGRVTMTTDTSTSTAYMELRSLRSDDTAVYYCARGGGPLRSRYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVCTLPPSRDELTKNQVSLTCLVEGFYPSDIAVEWESNGQPENNYKTTPPVLDSDGSFFLYSDLTVDKSRWQQGNVFSCSVMHEALHNHYTQESLSLSPGK

SEQ ID NO: 406 - protein, 448 aa, Artificial Sequence
  Description of Artificial Sequence: Synthetic polypeptide
QVQLVQSGAEVKKPGASVKVSCKASGYTFTNSGMNWVRQAPGQGLEWMGWINTNTGEPTFAEEFRGRVTMTRDTSISTAYMELSRLRSDDTAVYYCARYYYGNSFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVCTLPPSRDELTKNQVSLTCLVEGFYPSDIAVEWESNGQPENNYKTTPPVLDSDGSFFLYSDLTVDKSRWQQGNVFSCSVMHEALHNHYTQESLSLSPGK

SEQ ID NO: 407 - protein, 448 aa, Artificial Sequence
  Description of Artificial Sequence: Synthetic polypeptide
QVQLVQSGAEVKKPGASVKVSCKASGYTFTNYGMNWVRQAPGQGLEWMGWINTNTGEPTYAEEFKGRVTMTRDTSISTAYMELSRLRSDDTAVYYCARYFYGNSFVYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVCTLPPSRDELTKNQVSLTCLVEGFYPSDIAVEWESNGQPENNYKTTPPVLDSDGSFFLYSDLTVDKSRWQQGNVFSCSVMHEALHNHYTQESLSLSPGK

SEQ ID NO: 408 - protein, 449 aa, Artificial Sequence
  Description of Artificial Sequence: Synthetic polypeptide
QVQLVQSGAEVKKPGSSVKVSCKASGYAFNNYWMNWVRQAPGQGLEWMGQISPGNGNSNFNGKFKGRVTITADKSTSTAYMELSSLRSEDTAVYYCARGGRYGNAMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVCTLPPSRDELTKNQVSLTCLVEGFYPSDIAVEWESNGQPENNYKTTPPVLDSDGSFFLYSDLTVDKSRWQQGNVFSCSVMHEALHNHYTQESLSLSPGK

SEQ ID NO: 409 - protein, 449 aa, Artificial Sequence
  Description of Artificial Sequence: Synthetic polypeptide
QVQLVQSGAEVKKPGSSVKVSCKASGYAFSSYWMNWVRQAPGQGLEWIGQIYPGNGNSNFNGKFKARVTLTADKSSSTAYMELSSLRSEDTAVYYCARGGRFGNAMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVCTLPPSRDELTKNQVSLTCLVEGFYPSDIAVEWESNGQPENNYKTTPPVLDSDGSFFLYSDLTVDKSRWQQGNVFSCSVMHEALHNHYTQESLSLSPGK

SEQ ID NO: 410 - protein, 449 aa, Artificial Sequence
  Description of Artificial Sequence: Synthetic polypeptide
QVQLVQSGAEVKKPGSSVKVSCKASGYAFSSYWMNWVRQAPGQGLEWMGQIYPGNGNSNFNGKFKARVTITADKSTSTAYMELSSLRSEDTAVYYCARGGRFGNAMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVCTLPPSRDELTKNQVSLTCLVEGFYPSDIAVEWESNGQPENNYKTTPPVLDSDGSFFLYSDLTVDKSRWQQGNVFSCSVMHEALHNHYTQESLSLSPGK

SEQ ID NO: 411 - protein, 220 aa, Artificial Sequence
  Description of Artificial Sequence: Synthetic polypeptide
DIVMTQSPDSLAVSLGERATINCKSSQSLLNSGNQKNYLTWYQQKPGQPPKLLIFWASTRESGVPDRFSGSGSGTDFTLTISSLQAEDVAVYYCQNNYYYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 412 - protein, 220 aa, Artificial Sequence
  Description of Artificial Sequence: Synthetic polypeptide
DIVMTQSPDSLAVSLGERATINCKSSQSLLNSGNQKNYLTWYQQKPGQPPKLLIYWASTRESGVPDRFSGSGSGTDFTLTISSLQAEDVAVYYCQNAYFYPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 413 - protein, 220 aa, Artificial Sequence
  Description of Artificial Sequence: Synthetic polypeptide
DIVMTQSPDSLAVSLGERATINCKSSQSLLNSGNQKNYLTWYQQKPGQPPKLLIYWASTRESGVPDRFSGSGSGTDFTLTISSLQAEDVAVYYCQNNYFYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 414 - protein, 220 aa, Artificial Sequence
  Description of Artificial Sequence: Synthetic polypeptide
DIVMTQSPDSLAVSLGERATINCKSSQSLLNSGNQKNYLTWYQQKPGQPPKLLIYWASTRESGVPDRFSGSGSGTDFTLTISSLQAEDVAVYYCQNNYNFPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 415 - protein, 220 aa, Artificial Sequence
  Description of Artificial Sequence: Synthetic polypeptide
DIVMTQSPDSLAVSLGERATINCKSSQSLLNSGNQKNYLTWYQQKPGQPPKLLIYWASTRESGVPDRFSGSGSGTDFTLTISSLQAEDVAVYYCQNNYYYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 416 - protein, 220 aa, Artificial Sequence
  Description of Artificial Sequence: Synthetic polypeptide
DIVMTQSPDSLAVSLGERATINCKSSQSLLNSGNQRNYLTWYQQKPGQPPKLLIYWASTRESGVPDRFSGSGSGTDFTLTISSLQAEDVAVYYCQNAYFYPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 417 - protein, 220 aa, Artificial Sequence
  Description of Artificial Sequence: Synthetic polypeptide
DIVMTQSPDSLAVSLGERATINCRSSQSLFSSGNQKNYLTWYQQKPGQPPKLLIYWASTRESGVPDRFSGSGSGADFTLTISSLQAEDVAVYYCQNDYYYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 418 - protein, 220 aa, Artificial Sequence
  Description of Artificial Sequence: Synthetic polypeptide
DIVMTQSPDSLAVSLGERATINCRSSQSLFSSGNQKNYLTWYQQKPGQPPKLLIYWASTRESGVPDRFSGSGSGTDFTLTISSLQAEDVAVYYCQNDYYYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 419 - protein, 220 aa, Artificial Sequence
  Description of Artificial Sequence: Synthetic polypeptide
DIVMTQSPDSLAVSLGERATMNCKSSQSLLNSGNQKNYLTWYQQKPGQPPKLLIYWASTRESGVPDRFSGSGSGTDFTLTISSLQAEDVAVYYCQNAYFYPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 420 - protein, 120 aa, Artificial Sequence
  Description of Artificial Sequence: Synthetic polypeptide
QVQLVQSGAEVKKPGASVKVSCKASGYTFTSYYIHWVRQAPGQGLEWIGCIYPGNVNTNYNEKFKDRATLTVDTSISTAYMELSRLRSDDTAVYFCTRSHYGLDWNFDVWGQGTTVTVSS

SEQ ID NO: 421 - protein, 120 aa, Artificial Sequence
  Description of Artificial Sequence: Synthetic polypeptide
QVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSS

SEQ ID NO: 422 - protein, 120 aa, Artificial Sequence
  Description of Artificial Sequence: Synthetic polypeptide
QVQLVQSGAEVKKPGASVKVSCKASGYTFTSYYIHWVRQAPGQGLEWIGAIYPGNVNTNYNEKFKDRATLTVDTSISTAYMELSRLRSDDTAVYFCTRSHYGLDWNFDVWGQGTTVTVSS

SEQ ID NO: 423 - protein, 120 aa, Artificial Sequence
  Description of Artificial Sequence: Synthetic polypeptide
QVQLVQSGAEVKKPGASVKVSCKASGYTFTSYYIHWVRQAPGQGLEWIGGIYPGNVNTNYNEKFKDRATLTVDTSISTAYMELSRLRSDDTAVYFCTRSHYGLDWNFDVWGQGTTVTVSS

SEQ ID NO: 424 - protein, 107 aa, Artificial Sequence
  Description of Artificial Sequence: Synthetic polypeptide
DIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIK

SEQ ID NO: 425 - protein, 450 aa, Artificial Sequence
  Description of Artificial Sequence: Synthetic polypeptide
QVQLVQSGAEVKKPGASVKVSCKASGYTFTSYYIHWVRQAPGQGLEWIGCIYPGNVNTNYNEKFKDRATLTVDTSISTAYMELSRLRSDDTAVYFCTRSHYGLDWNFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVCTLPPSRDELTKNQVSLTCLVEGFYPSDIAVEWESNGQPENNYKTTPPVLDSDGSFFLYSDLTVDKSRWQQGNVFSCSVMHEALHNHYTQESLSLSPGK

SEQ ID NO: 426 - protein, 214 aa, Artificial Sequence
  Description of Artificial Sequence: Synthetic polypeptide
DIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 427 - protein, 479 aa, Artificial Sequence
  Description of Artificial Sequence: Synthetic polypeptide
QVQLVQSGAEVKKPGASVKVSCKASGYTFTSYYIHWVRQAPGQGLEWIGCIYPGNVNTNYNEKFKDRATLTVDTSISTAYMELSRLRSDDTAVYFCTRSHYGLDWNFDVWGQGTTVTVSSGKPGSGKPGSGKPGSGKPGSDIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 428 - protein, 479 aa, Artificial Sequence
  Description of Artificial Sequence: Synthetic polypeptide
QVQLVQSGAEVKKPGASVKVSCKASGYTFTSYYIHWVRQAPGQGLEWIGGIYPGNVNTNYNEKFKDRATLTVDTSISTAYMELSRLRSDDTAVYFCTRSHYGLDWNFDVWGQGTTVTVSSGKPGSGKPGSGKPGSGKPGSDIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 429 - protein, 479 aa, Artificial Sequence
  Description of Artificial Sequence: Synthetic polypeptide
QVQLVQSGAEVKKPGASVKVSCKASGYTFTSYYIHWVRQAPGQGLEWIGAIYPGNVNTNYNEKFKDRATLTVDTSISTAYMELSRLRSDDTAVYFCTRSHYGLDWNFDVWGQGTTVTVSSGKPGSGKPGSGKPGSGKPGSDIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 430 - protein, 479 aa, Artificial Sequence
  Description of Artificial Sequence: Synthetic polypeptide
QVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSSGKPGSGKPGSGKPGSGKPGSDIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 431 - protein, 472 aa, Artificial Sequence
  Description of Artificial Sequence: Synthetic polypeptide
QVQLVQSGAEVKKPGASVKVSCKASDYTFSNYYIEWVRQAPGQGLEWMGEILPGNGNTVYNEKFKDRVTMTVDTSTSTAYMELRSLRSDDTAVYYCARWGDYALFANWGQGTLVTVSSGGGGSGGGGSGGGGSDIQMTQSPSTLSASVGDRVTITCKASQNVGTNVAWYQQKPGKAPKALIYSASYRYSGVPSRFSGSGSGTEFTLTISSLQPDDFATYYCQQYNSYPFTFGQGTKLEIKEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 432 - protein, 476 aa, Artificial Sequence
  Description of Artificial Sequence: Synthetic polypeptide
QVQLVQSGAEVKKPGASVKVSCKASGYTFTDYFMNWVRQAPGQGLEWMGVINPYNDITIYNQKFQGRVTMTVDRSTSTVYMELSSLRSEDTAVYYCAREGVLYDGYYEGAYWGQGTLVTVSSGGGGSGGGGSGGGGSDIQLTQSPSFLSASVGDRVTITCKASQNVGIAVAWYQQKPGKAPKLLIYAASNRYTGVPSRFSGSGSGTEFTLTISSLQPEDFATYYCQQYSTYPYTFGQGTKLEIKEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 433 - protein, 472 aa, Artificial Sequence
  Description of Artificial Sequence: Synthetic polypeptide
QVQLVQSGAEVKKPGASVKVSCKATDYIFSNYYIEWVRQAPGQGLEWMGEILPGTGNTVYNEKFKDRVTMTVDTSTSTVYMELSSLRSEDTAVYYCARWGDYALFANWGQGTLVTVSSGGGGSGGGGSGGGGSDIQMTQSPSFLSASVGDRVTITCKASQNVGTNVAWYQQKPGKAPKPLIYSTSYRYSGVPSRFSGSGSGTEFTLTISSLQPEDFATYYCQQYNNYPLTFGGGTKVEIKEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 434 - protein, 472 aa, Artificial Sequence
  Description of Artificial Sequence: Synthetic polypeptide
QVQLVQSGAEVKKPGASVKVSCKATDYIFSNYYIEWVRQAPGQGLEWMGEILPGTGNTVYNEKFKDRVTMTVDTSTSTVYMELSSLRSEDTAVYYCARWGDYALFANWGQGTLVTVSSGGGGSGGGGSGGGGSDIQMTQSPSTLSASVGDRVTITCKASQNVGTNVAWYQQKPGKAPKALIYSASYRYSGVPSRFSGSGSGTEFTLTISSLQPDDFATYYCQQYNSYPFTFGQGTKLEIKEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 435 - protein, 479 aa, Artificial Sequence
  Description of Artificial Sequence: Synthetic polypeptide
QVQLVQSGAEVKKPGASVKVSCKASGYTFTSYYIHWVRQAPGQCLEWIGSIYPGNVNTNYNEKFKDRATLTVDTSISTAYMELSRLRSDDTAVYFCTRSHYGLDWNFDVWGQGTTVTVSSGKPGSGKPGSGKPGSGKPGSDIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGCGTKVEIKEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 436 - protein, 479 aa, Artificial Sequence
  Description of Artificial Sequence: Synthetic polypeptide
QVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSSGGGGSGGGGSGGGGSGGGGSDIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 437 - protein, 451 aa, Artificial Sequence
  Description of Artificial Sequence: Synthetic polypeptide
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVCTLPPSRDELTKNQVSLTCLVEGFYPSDIAVEWESNGQPENNYKTTPPVLDSDGSFFLYSDLTVDKSRWQQGNVFSCSVMHEALHNHYTQESLSLSPGK

SEQ ID NO: 438 - protein, 216 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSNWPPALTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 439 - protein, 449 aa, Artificial Sequence
  Description of Artificial Sequence: Synthetic polypeptide
QVQLVQSGAEVKKPGASVKVSCKASGYTFSSYWMHWVRQAPGQRLEWMGEINPGNGHTNYSQKFQGRVTITVDKSASTAYMELSSLRSEDTAVYYCARSFTTARAFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVCTLPPSRDELTKNQVSLTCLVEGFYPSDIAVEWESNGQPENNYKTTPPVLDSDGSFFLYSDLTVDKSRWQQGNVFSCSVMHEALHNHYTQESLSLSPGK

SEQ ID NO: 440 - protein, 214 aa, Artificial Sequence
  Description of Artificial Sequence: Synthetic polypeptide
DIVMTQSPPTLSLSPGERVTLSCRASQSISDYLHWYQQKPGQSPRLLIKYASQSISGIPARFSGSGSGTDFTLTISSLEPEDFAVYYCQDGHSFPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 441 - protein, 482 aa, Artificial Sequence
  Description of Artificial Sequence: Synthetic polypeptide
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSGKPGSGKPGSGKPGSGKPGSEIVLTQSPATLSLSPGERATLSCRASQSVSSYLAWYQQKPGQAPRLLIYDASNRATGIPARFSGSGSGTDFTLTISSLEPEDFAVYYCQQRSNWPPALTFGGGTKVEIKEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 442 - protein, 478 aa, Artificial Sequence
  Description of Artificial Sequence: Synthetic polypeptide
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPPALTFGGGTKVEIKREPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 443 - protein, 492 aa, Artificial Sequence
  Description of Artificial Sequence: Synthetic polypeptide
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSGGGGSGGGGSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPPALTFGGGTKVEIKEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 444 - protein, 482 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSNWPPALTFGGGTKVEIKGKPGSGKPGSGKPGSGKPGSQVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 445 - protein, 478 aa, Artificial Sequence
  Description of Artificial Sequence: Synthetic polypeptide
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPPALTFSGGTKVEIKREPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 446 - protein, 483 aa, Artificial Sequence
  Description of Artificial Sequence: Synthetic polypeptide
QVQLQESGPGLVKPSETLSLTCTVSGGSFSGYYWSWIRQPPGKGLEWIGEINHGGYVTYNPSLESRVTISVDTSKNQFSLKLSSVTAADTAVYYCARDYGPGNYDWYFDLWGRGTLVTVSSGKPGSGKPGSGKPGSGKPGSEIVLTQSPGTLSLSPGERATLSCRASQSVSSSYLAWYQQKPGQAPRLLIYDASNRATGIPDRFSGSGSGTDFTLTISRLEPEDFAVYYCQQRSNWPPALTFGGGTKVEIKEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 447 - protein, 483 aa, Artificial Sequence
  Description of Artificial Sequence: Synthetic polypeptide
EVQLLESGGGLVQPGGSLRLSCAASGGSFSGYYWSWVRQAPGKGLEWVSEINHGGYVTYNPSLESRFTISRDNSKNTLYLQMNSLRAEDTAVYYCAKDYGPGNYDWYFDLWGRGTLVTVSSGKPGSGKPGSGKPGSGKPGSEIVLTQSPGTLSLSPGERATLSCRASQSVSSSYLAWYQQKPGQAPRLLIYDASNRATGIPDRFSGSGSGTDFTLTISRLEPEDFAVYYCQQRSNWPPALTFGGGTKVEIKEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 448 - protein, 483 aa, Artificial Sequence
  Description of Artificial Sequence: Synthetic polypeptide
QVQLVQSGAEVKKPGSSVKVSCKASGGSFSGYYWSWVRQAPGQGLEWMGEINHGGYVTYNPSLESRVTITADESTSTAYMELSSLRSEDTAVYYCARDYGPGNYDWYFDLWGRGTLVTVSSGKPGSGKPGSGKPGSGKPGSEIVLTQSPGTLSLSPGERATLSCRASQSVSSSYLAWYQQKPGQAPRLLIYDASNRATGIPDRFSGSGSGTDFTLTISRLEPEDFAVYYCQQRSNWPPALTFGGGTKVEIKEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 449 - protein, 482 aa, Artificial Sequence
  Description of Artificial Sequence: Synthetic polypeptide
QVQLQQWGAGLLKPSETLSLTCAVYGGSFSGYYWSWIRQSPEKCLEWIGEINHGGYVTYNPSLESRVTISVDTSKNQFSLKLSSVTAADTAVYYCARDYGPGNYDWYFDLWGRGTLVTVSSGKPGSGKPGSGKPGSGKPGSEIVLTQSPATLSLSPGERATLSCRASQSVSSYLAWYQQKPGQAPRLLIYDASNRATGIPARFSGSGSGTDFTLTISSLEPEDFAVYYCQQRSNWPPALTFGCGTKVEIKEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 450 - protein, 482 aa, Artificial Sequence; identical to SEQ ID NO: 449
  Description of Artificial Sequence: Synthetic polypeptide

SEQ ID NO: 451 - protein, 478 aa, Artificial Sequence
  Description of Artificial Sequence: Synthetic polypeptide
QVQLVQSGAEVKKPGASVKVSCKASGYTFSSYWMHWVRQAPGQRLEWMGEINPGNGHTNYSQKFQGRVTITVDKSASTAYMELSSLRSEDTAVYYCARSFTTARAFAYWGQGTLVTVSSGKPGSGKPGSGKPGSGKPGSDIVMTQSPPTLSLSPGERVTLSCRASQSISDYLHWYQQKPGQSPRLLIKYASQSISGIPARFSGSGSGTDFTLTISSLEPEDFAVYYCQDGHSFPPTFGGGTKVEIKEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 452 - protein, 478 aa, Artificial Sequence
  Description of Artificial Sequence: Synthetic polypeptide
QVQLVQSGAEVKKPGASVKVSCKASGYTFSSYWMHWVRQAPGQRLEWMGEINPGNGHTNYAQKFQGRVTITVDKSASTAYMELSSLRSEDTAVYYCARSFTTARAFAYWGQGTLVTVSSGKPGSGKPGSGKPGSGKPGSDIVMTQSPPTLSLSPGERVTLSCRASQSISDYLHWYQQKPGQSPRLLIKYASQSISGIPARFSGSGSGTDFTLTISSLEPEDFAVYYCQDGHSFPPTFGGGTKVEIKEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 453 - protein, 478 aa, Artificial Sequence
  Description of Artificial Sequence: Synthetic polypeptide
QVQLVQSGAEVKKPGASVKVSCKASGYTFSSYWMHWVRQAPGQRLEWMGEINPGNGHTNYNQKFQGRVTITVDKSASTAYMELSSLRSEDTAVYYCARSFTTARAFAYWGQGTLVTVSSGKPGSGKPGSGKPGSGKPGSDIVMTQSPPTLSLSPGERVTLSCRASQSISDYLHWYQQKPGQSPRLLIKYASQSISGIPARFSGSGSGTDFTLTISSLEPEDFAVYYCQDGHSFPPTFGGGTKVEIKEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 454 - protein, 479 aa, Artificial Sequence
  Description of Artificial Sequence: Synthetic polypeptide
EVQLVESGGGLVQPGGSLRLSCAASGFTFSDYWMSWVRQAPGKGLEWVADIKNDGSYTNYAPSLTNRFTISRDNAKNSLYLQMNSLRAEDTAVYYCARELTGTWGQGTMVTVSSGKPGSGKPGSGKPGSGKPGSDIVMTQSPDSLAVSLGERATINCKSSQSLLSSGNQKNYLAWYQQKPGQPPKLLIYYASTRQSGVPDRFSGSGSGTDFTLTISSLQAEDVAVYYCLQYDRYPFTFGQGTKLEIKEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 455 - protein, 479 aa, Artificial Sequence
  Description of Artificial Sequence: Synthetic polypeptide
EVQLVESGGGLVQPGGSLRLSCAASGFTFSDYWMSWVRQAPGKGLEWVADIKNDGSYTNYVDSVKGRFTISRDNAKNSLYLQMNSLRAEDTAVYYCARELTGTWGQGTLVTVSSGKPGSGKPGSGKPGSGKPGSDIIMTQSPDSLAVSLGERATINCKSSQSLLSSGNQKNYLAWYQQKPGQPPELLIYYASTRQSGVPDRFSGSGSGTDFTLTISSLQAEDVAVYYCLQYDRYPFTFGQGTKLEIKEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 456 - protein, 479 aa, Artificial Sequence
  Description of Artificial Sequence: Synthetic polypeptide
EVQLVESGGGLVQPGGSLRLSCAASGFTFSDYWMSWVRQAPGKGLEWVADIKNDGSYTNYVDSVKGRFTISRDNAKNSLYLQMNSLRAEDTAVYYCARELTGTWGQGTLVTVSSGKPGSGKPGSGKPGSGKPGSDIVMTQSPDSLAVSLGERATINCKSSQSLLSSGNQKNYLAWYQQKPGQPPKLLIYYASTRQSGVPDRFSGSGSGTDFTLTISSLQAEDVAVYYCLQYDRYPFTFGQGTKLEIKEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 457 - protein, 479 aa, Artificial Sequence
  Description of Artificial Sequence: Synthetic polypeptide
EVQLVESGGGLVQPGGSLRLSCAASGFTFSDYWMSWVRQAPGKGMEWVGDIKNDGSYTNYAPSLTNRFTISRDNARNSLYLQMNSLRAEDTAVYYCTRELTGTWGQGTLVTVSSGKPGSGKPGSGKPGSGKPGSDIIMTQSPDSLAVSLGERATINCKSSQSLLSSGNQKNYLAWYQQKPGQPPELLIYYASTRQSGVPDRFSGSGSGTDFTLTISSLQAEDVAVYYCLQYDRYPFTFGQGTKLEIKEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 458 - protein, 479 aa, Artificial Sequence
  Description of Artificial Sequence: Synthetic polypeptide
EVQLVESGGGLVQPGGSLRLSCAASGFTFSDYWMSWVRQAPGKGMEWVGDIKNDGSYTNYAPSLTNRFTISRDNARNSLYLQMNSLRAEDTAVYYCTRELTGTWGQGTLVTVSSGKPGSGKPGSGKPGSGKPGSDIVMTQSPDSLAVSLGERATINCKSSQSLLSSGNQKNYLAWYQQKPGQPPKLLIYYASTRQSGVPDRFSGSGSGTDFTLTISSLQAEDVAVYYCLQYDRYPFTFGQGTKLEIKEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 459 - protein, 478 aa, Artificial Sequence
  Description of Artificial Sequence: Synthetic polypeptide
QVKLVESGAEVKKPGASVKVSCKASGYTFTSYWMHWVRQAPGQVLEWMGEINPGNGHTSYAQKFQGRVTLTVDKSTSTAYMELSSLRSEDTAVYYCARSFTTARAFAYWGQGTTVTVSSGKPGSGKPGSGKPGSGKPGSDIQMTQSPSSLSASVGDRVTITCRASQSISDYLHWYQQKPGKAPKLLIKYASQSISGVPSRFSGSGSGTDFTLTISSLQPEDFATYYCQDSHSFPPTFGGGTKVEIKEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 460 - protein, 478 aa, Artificial Sequence
  Description of Artificial Sequence: Synthetic polypeptide
QVKLVESGAEVKKPGASVKVSCKASGYTFTSYWMHWVRQAPGQVLEWMGEINPGNGHTSYAQKFQGRVTLTVDKSTSTAYMELSSLRSEDTAVYYCARSFTTARAFAYWGQGTTVTVSSGKPGSGKPGSGKPGSGKPGSDIVMTQSPPTLSLSPGERVTLSCRASQSISDYLHWYQQKPGQSPRLLIKYASQSISGIPARFSGSGSGTDFTLTISSLEPEDFAVYYCQDGHSFPPTFGGGTKVEIKEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 461 - protein, 479 aa, Artificial Sequence
  Description of Artificial Sequence: Synthetic polypeptide
QVQLVQSGAEVKKPGASVKLSCKASGYTFSSYWMEIWVRQAPGQGLEWIGEINPGNGHTNYNEKFKSRVTMTRDTSTSTAYMELSSLRSEDTAVYYCARSFKTARAFAYWGQGTLVTVSSGKPGSGKPGSGKPGSGKPGSDIVMTQSPAFLSVTPGEKVTITCRASQTISDYLHWYQQKPDQAPKLLIKYASQSISGIPSRFSGSGSGTDFTFTISSLEAEDAATYYCQDGHSWPPTFGQGTKLEIKEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 462 - protein, 478 aa, Artificial Sequence
  Description of Artificial Sequence: Synthetic polypeptide
QVQLVQSGAEVKKPGASVKVSCKASGYTFTSYWMHWVRQAPGQGLEWMGIINPGNGHTSYAQKFQGRVTMTRDTSTSTVYMELSSLRSEDTAVYYCARSFTTARAFAYWGQGTTVTVSSGKPGSGKPGSGKPGSGKPGSDIQMTQSPSSLSASVGDRVTITCRASQSISDYLHWYQQKPGKAPKLLIKYASQSISGVPSRFSGSGSGTDFTLTISSLQPEDFATYYCQDSHSFPPTFGGGTKVEIKEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 463 - protein, 478 aa, Artificial Sequence
  Description of Artificial Sequence: Synthetic polypeptide
QVQLVQSGAEVKKPGASVKVSCKASGYTFTSYWMHWVRQAPGQGLEWMGIINPGNGHTSYAQKFQGRVTMTRDTSTSTVYMELSSLRSEDTAVYYCARSFTTARAFAYWGQGTTVTVSSGKPGSGKPGSGKPGSGKPGSDIVMTQSPPTLSLSPGERVTLSCRASQSISDYLHWYQQKPGQSPRLLIKYASQSISGIPARFSGSGSGTDFTLTISSLEPEDFAVYYCQDGHSFPPTFGGGTKVEIKEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 464 - protein, 478 aa, Artificial Sequence
  Description of Artificial Sequence: Synthetic polypeptide
QVQLVQSGAEVKKPGASVKVSCKASGYTFTSYWMHWVRQAPGQRLEWMGEINPSNGHTKYSQKFQGRVTITVDKSASTAYMELSSLRSEDTAVYYCARSFTTARAFAYWGQGTLVTVSSGKPGSGKPGSGKPGSGKPGSDIQMTQSPSSLSASVGDRVTITCRASQSISDYLHWYQQKPGKAPKLLIKYASQSISGVPSRFSGSGSGTDFTLTISSLQPEDFATYYCQDSHSFPPTFGGGTKVEIKEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 465 - protein, 478 aa, Artificial Sequence
  Description of Artificial Sequence: Synthetic polypeptide
QVQLVQSGAEVKKPGASVKVSCKASGYTFTSYWMHWVRQAPGQRLEWMGEINPSNGHTKYSQKFQGRVTITVDKSASTAYMELSSLRSEDTAVYYCARSFTTARAFAYWGQGTLVTVSSGKPGSGKPGSGKPGSGKPGSDIVMTQSPPTLSLSPGERVTLSCRASQSISDYLHWYQQKPGQSPRLLIKYASQSISGIPARFSGSGSGTDFTLTISSLEPEDFAVYYCQDGHSFPPTFGGGTKVEIKEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 466 - protein, 481 aa, Artificial Sequence
  Description of Artificial Sequence: Synthetic polypeptide
QVQLVQSGAEVKKPGASVKVSCKASGYTFTDYFMNWVRQAPGQCLEWMGVINPYNDITIYNQKFQGRVTMTVDRSTSTVYMELSSLRSEDTAVYYCAREGVLYDGYYEGAYWGQGTLVTVSSGKPGSGKPGSGKPGSGKPGSDIQLTQSPSFLSASVGDRVTITCKASQNVGIAVAWYQQKPGKAPKLLIYAASNRYTGVPSRFSGSGSGTEFTLTISSLQPEDFATYYCQQYSTYPYTFGCGTKLEIKEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 467 - protein, 482 aa, Artificial Sequence
  Description of Artificial Sequence: Synthetic polypeptide
EVQLLESGGGLVQPGGSLRLSCAASGFTFSSYGMHWVRQAPGKGLEWVAVISHHGSSKYYADSVKGRFTISRDNSKNTLYLQMNSLRAEDTAVYYCARDWFFYLFDYWGQGTLVTVSSGKPGSGKPGSGKPGSGKPGSDIVMTQSPLSLPVTPGEPASISCKSSQSLLHSDGKTFLYWYLQKPGQSPQLLIYEVSNRFSGVPDRFSGSGSGTDFTLKISRVEAEDVGVYYCLQGERLPFTFGQGTKVEIKEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 468 - protein, 728 aa, Artificial Sequence
  Description of Artificial Sequence: Synthetic polypeptide
QVQLVQSGAEVKKPGASVKVSCKASGYTFTDYFMNWVRQAPGQGLEWMGVINPYNDITIYNQKFQGRVTMTVDRSTSTVYMELSSLRSEDTAVYYCAREGVLYDGYYEGAYWGQGTLVTVSSGGGGSGGGGSGGGGSDIQLTQSPSFLSASVGDRVTITCKASQNVGIAVAWYQQKPGKAPKLLIYAASNRYTGVPSRFSGSGSGTEFTLTISSLQPEDFATYYCQQYSTYPYTFGQGTKLEIKSGGGGSQVQLVQSGAEVKKPGASVKVSCKASGYTFSSYWMHWVRQAPGQRLEWMGEINPGNGHTNYSQKFQGRVTITVDKSASTAYMELSSLRSEDTAVYYCARSFTTARAFAYWGQGTLVTVSSGKPGSGKPGSGKPGSGKPGSDIVMTQSPPTLSLSPGERVTLSCRASQSISDYLHWYQQKPGQSPRLLIKYASQSISGIPARFSGSGSGTDFTLTISSLEPEDFAVYYCQDGHSFPPTFGGGTKVEIKEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 469 - protein, 730 aa, Artificial Sequence
  Description of Artificial Sequence: Synthetic polypeptide
QVQLVQSGAEVKKPGASVKVSCKASGYTFSSYWMHWVRQAPGQRLEWMGEINPGNGHTNYSQKFQGRVTITVDKSASTAYMELSSLRSEDTAVYYCARSFTTARAFAYWGQGTLVTVSSGGGGSGGGGSGGGGSGGGGSDIVMTQSPPTLSLSPGERVTLSCRASQSISDYLHWYQQKPGQSPRLLIKYASQSISGIPARFSGSGSGTDFTLTISSLEPEDFAVYYCQDGHSFPPTFGGGTKVEIKSGGGGSQVQLVQSGAEVKKPGASVKVSCKASGYTFSSYWMHWVRQAPGQRLEWMGEINPGNGHTNYSQKFQGRVTITVDKSASTAYMELSSLRSEDTAVYYCARSFTTARAFAYWGQGTLVTVSSGKPGSGKPGSGKPGSGKPGSDIVMTQSPPTLSLSPGERVTLSCRASQSISDYLHWYQQKPGQSPRLLIKYASQSISGIPARFSGSGSGTDFTLTISSLEPEDFAVYYCQDGHSFPPTFGGGTKVEIKEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 470 - protein, 699 aa, Artificial Sequence
  Description of Artificial Sequence: Synthetic polypeptide
QVQLVQSGAEVKKPGASVKVSCKASGYTFSSYWMHWVRQAPGQRLEWMGEINPGNGHTNYSQKFQGRVTITVDKSASTAYMELSSLRSEDTAVYYCARSFTTARAFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVCTLPPSRDELTKNQVSLTCLVEGFYPSDIAVEWESNGQPENNYKTTPPVLDSDGSFFLYSDLTVDKSRWQQGNVFSCSVMHEALHNHYTQESLSLSPGKSGGGGSQVQLVQSGAEVKKPGASVKVSCKASGYTFTDYFMNWVRQAPGQGLEWMGVINPYNDITIYNQKFQGRVTMTVDRSTSTVYMELSSLRSEDTAVYYCAREGVLYDGYYEGAYWGQGTLVTVSSGGGGSGGGGSGGGGSDIQLTQSPSFLSASVGDRVTITCKASQNVGIAVAWYQQKPGKAPKLLIYAASNRYTGVPSRFSGSGSGTEFTLTISSLQPEDFATYYCQQYSTYPYTFGQGTKLEIK

SEQ ID NO: 471 - protein, 701 aa, Artificial Sequence
  Description of Artificial Sequence: Synthetic polypeptide
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGKSGGGGSQVQLVQSGAEVKKPGASVKVSCKASGYTFTDYFMNWVRQAPGQGLEWMGVINPYNDITIYNQKFQGRVTMTVDRSTSTVYMELSSLRSEDTAVYYCAREGVLYDGYYEGAYWGQGTLVTVSSGGGGSGGGGSGGGGSDIQLTQSPSFLSASVGDRVTITCKASQNVGIAVAWYQQKPGKAPKLLIYAASNRYTGVPSRFSGSGSGTEFTLTISSLQPEDFATYYCQQYSTYPYTFGQGTKLEIK

SEQ ID NO: 472 - protein, 699 aa, Artificial Sequence
  Description of Artificial Sequence: Synthetic polypeptide
QVQLVQSGAEVKKPGASVKVSCKASGYTFSSYWMHWVRQAPGQRLEWMGEINPGNGHTNYSQKFQGRVTITVDKSASTAYMELSSLRSEDTAVYYCARSFTTARAFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGKSGGGGSQVQLVQSGAEVKKPGASVKVSCKASGYTFTDYFMNWVRQAPGQGLEWMGVINPYNDITIYNQKFQGRVTMTVDRSTSTVYMELSSLRSEDTAVYYCAREGVLYDGYYEGAYWGQGTLVTVSSGGGGSGGGGSGGGGSDIQLTQSPSFLSASVGDRVTITCKASQNVGIAVAWYQQKPGKAPKLLIYAASNRYTGVPSRFSGSGSGTEFTLTISSLQPEDFATYYCQQYSTYPYTFGQGTKLEIK

SEQ ID NO: 473 - protein, 701 aa, Artificial Sequence
  Description of Artificial Sequence: Synthetic polypeptide
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVCTLPPSRDELTKNQVSLTCLVEGFYPSDIAVEWESNGQPENNYKTTPPVLDSDGSFFLYSDLTVDKSRWQQGNVFSCSVMHEALHNHYTQESLSLSPGKSGGGGSQVQLVQSGAEVKKPGASVKVSCKASGYTFTDYFMNWVRQAPGQGLEWMGVINPYNDITIYNQKFQGRVTMTVDRSTSTVYMELSSLRSEDTAVYYCAREGVLYDGYYEGAYWGQGTLVTVSSGGGGSGGGGSGGGGSDIQLTQSPSFLSASVGDRVTITCKASQNVGIAVAWYQQKPGKAPKLLIYAASNRYTGVPSRFSGSGSGTEFTLTISSLQPEDFATYYCQQYSTYPYTFGQGTKLEIK

SEQ ID NO: 474 - protein, 474 aa, Artificial Sequence
  Description of Artificial Sequence: Synthetic polypeptide
EVQLVQSGAEVKKPGESLKISCKGSGYEFSSHWMNWVRQMPGKCLEWMGQIYPGDGDINYNEKFRGQVTISADKSISTAYLQWSSLKASDTAMYYCARHGNYVMDYWGQGTLVTVSSGKPGSGKPGSGKPGSGKPGSIQLTQSPSFLSASVGDRVTITCSASSSVSYMFWYQQKPGKAPKPWIYRTSNLASGVPSRFSGSGSGTEFTLTISSLQPEDFATYYCQQFHDYPRTFGCGTKVEIKEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 475 - protein, 486 aa, Artificial Sequence
  Description of Artificial Sequence: Synthetic polypeptide
QVQLVQSGAEVKKPGASVKVSCKASGYTFTNFGITWVRQAPGQGLEWMGEIYPSSGNTFYNEKFKGRVTMTTDTSTSTAYMELRSLRSDDTAVYYCARGGGPLRSRYFDYWGQGTLVTVSSGKPGSGKPGSGKPGSGKPGSDIVMTQSPDSLAVSLGERATINCRSSQSLFSSGNQKNYLTWYQQKPGQPPKLLIYWASTRESGVPDRFSGSGSGTDFTLTISSLQAEDVAVYYCQNDYYYPLTFGGGTKVEIKEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 476 - protein, 483 aa, Artificial Sequence
  Description of Artificial Sequence: Synthetic polypeptide
EVQLVESGGGLVQPGGSLRLSCAASGFTFSSFGMHWVRQAPGKGLEWVSYISSGNSAIYYADTVNGRFTISRDNAKNSLYLQMNSLRAEDTAVYYCARLRYGNSFDYWGQGTLVTVSSGKPGSGKPGSGKPGSGKPGSDIVMTQSPDSLAVSLGERATINCKSSQSLLNSGNQKNYLTWYQQKPGQPPKLLIYWASTRESGVPDRFSGSGSGTDFTLTISSLQAEDVAVYYCQNNYYYPLTFGGGTKVEIKEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 477 - protein, 484 aa, Artificial Sequence
  Description of Artificial Sequence: Synthetic polypeptide
QVQLVQSGAEVKKPGSSVKVSCKASGYAFNNYWMNWVRQAPGQGLEWMGQISPGNGNSNFNGKFKGRVTITADKSTSTAYMELSSLRSEDTAVYYCARGGRYGNAMDYWGQGTTVTVSSGKPGSGKPGSGKPGSGKPGSDIVMTQSPDSLAVSLGERATINCKSSQSLLNSGNQRNYLTWYQQKPGQPPKLLIYWASTRESGVPDRFSGSGSGTDFTLTISSLQAEDVAVYYCQNAYFYPYTFGGGTKVEIKEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 478 - protein, 483 aa, Artificial Sequence
  Description of Artificial Sequence: Synthetic polypeptide
QVQLVQSGAEVKKPGASVKVSCKASGYTFTNSGMNWVRQAPGQGLEWMGWINTNTGEPTFAEEFRGRVTMTRDTSISTAYMELSRLRSDDTAVYYCARYYYGNSFAYWGQGTLVTVSSGKPGSGKPGSGKPGSGKPGSDIVMTQSPDSLAVSLGERATINCKSSQSLLNSGNQKNYLTWYQQKPGQPPKLLIYWASTRESGVPDRFSGSGSGTDFTLTISSLQAEDVAVYYCQNNYFYPLTFGGGTKVEIKEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 479 - protein, 478 aa, Artificial Sequence; identical to SEQ ID NO: 462
  Description of Artificial Sequence: Synthetic polypeptide

SEQ ID NO: 480 - protein, 739 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFEYWGQGTLVTVSSGGGGSGGGGSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLSGGGGSQVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSSGKPGSGKPGSGKPGSGKPGSDIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 481 - protein, 739 aa, Artificial Sequence
  Description of Artificial Sequence: Synthetic polypeptide
QVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSSGKPGSGKPGSGKPGSGKPGSDIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFEYWGQGTLVTVSSGGGGSGGGGSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 482 - protein, 451 aa, Artificial Sequence
  Description of Artificial Sequence: Synthetic polypeptide
DVQLQESGPGLVKPSQSLSLTCTVTGYSITSDYAWNWIRQFPGNKLEWMGYIRYSGSTSYNPSLKSRISITRDTSKNQFFLQLNSVTTEDTATYYCARDWPRPSYWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVCTLPPSRDELTKNQVSLTCLVEGFYPSDIAVEWESNGQPENNYKTTPPVLDSDGSFFLYSDLTVDKSRWQQGNVFSCSVMHEALHNHYTQESLSLSPGK

SEQ ID NO: 483 - protein, 214 aa, Artificial Sequence
  Description of Artificial Sequence: Synthetic polypeptide
DIQTTQTTSSLSASLGDRVTISCRAGQDISNYLNWYQQKPDGTVKLLIYYTSRLHSGVPSRFSGSGSGTDYSLTISNLEQEDIATYFCQQGHTLPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 484 - protein, 739 aa, Artificial Sequence
  Description of Artificial Sequence: Synthetic polypeptide
EVQLVESGGGLVQPGGSLRLSCAASGFTFSDYWMSWVRQAPGKGLEWVADIKNDGSYTNYAPSLTNRFTISRDNAKNSLYLQMNSLRAEDTAVYYCARELTGTWGQGTMVTVSSGGGGSGGGGSGGGGSGGGGSDIVMTQSPDSLAVSLGERATINCKSSQSLLSSGNQKNYLAWYQQKPGQPPKLLIYYASTRQSGVPDRFSGSGSGTDFTLTISSLQAEDVAVYYCLQYDRYPFTFGQGTKLEIKSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFEYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 485 - protein, 711 aa, Artificial Sequence
  Description of Artificial Sequence: Synthetic polypeptide
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARNYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGKSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFEYWGQGTLVTVSSGGGGSGGGGSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 486 - protein, 738 aa, Artificial Sequence
  Description of Artificial Sequence: Synthetic polypeptide
QVQLVQSGAEVKKPGASVKVSCKASGYTFSSYWMHWVRQAPGQRLEWMGEINPGNGHTNYSQKFQGRVTITVDKSASTAYMELSSLRSEDTAVYYCARSFTTARAFAYWGQGTLVTVSSGGGGSGGGGSGGGGSGGGGSDIVMTQSPPTLSLSPGERVTLSCRASQSISDYLHWYQQKPGQSPRLLIKYASQSISGIPARFSGSGSGTDFTLTISSLEPEDFAVYYCQDGHSFPPTFGGGTKVEIKSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFEYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 487 - protein, 711 aa, Artificial Sequence
  Description of Artificial Sequence: Synthetic polypeptide
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGKSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFEYWGQGTLVTVSSGGGGSGGGGSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 488 - protein, 483 aa, Artificial Sequence
  Description of Artificial Sequence: Synthetic polypeptide
EPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVCTLPPSRDELTKNQVSLTCLVEGFYPSDIAVEWESNGQPENNYKTTPPVLDSDGSFFLYSDLTVDKSRWQQGNVFSCSVMHEALHNHYTQESLSLSPGKSGGGSQVQLVQSGAEVKKPGASVKVSCKASGYTFSSYWMHWVRQAPGQRLEWMGEINPGNGHTNYSQKFQGRVTITVDKSASTAYMELSSLRSEDTAVYYCARSFTTARAFAYWGQGTLVTVSSGKPGSGKPGSGKPGSGKPGSDIVMTQSPPTLSLSPGERVTLSCRASQSISDYLHWYQQKPGQSPRLLIKYASQSISGIPARFSGSGSGTDFTLTISSLEPEDFAVYYCQDGHSFPPTFGGGTKVEIK

SEQ ID NO: 489 - protein, 734 aa, Artificial Sequence
  Description of Artificial Sequence: Synthetic polypeptide
EPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVCTLPPSRDELTKNQVSLTCLVEGFYPSDIAVEWESNGQPENNYKTTPPVLDSDGSFFLYSDLTVDKSRWQQGNVFSCSVMHEALHNHYTQESLSLSPGKSGGGSQVQLVQSGAEVKKPGASVKVSCKASGYTFSSYWMHWVRQAPGQRLEWMGEINPGNGHTNYSQKFQGRVTITVDKSASTAYMELSSLRSEDTAVYYCARSFTTARAFAYWGQGTLVTVSSGKPGSGKPGSGKPGSGKPGSDIVMTQSPPTLSLSPGERVTLSCRASQSISDYLHWYQQKPGQSPRLLIKYASQSISGIPARFSGSGSGTDFTLTISSLEPEDFAVYYCQDGHSFPPTFGGGTKVEIKSGGGSQVQLVQSGAEVKKPGASVKVSCKASGYTFSSYWMHWVRQAPGQRLEWMGEINPGNGHTNYSQKFQGRVTITVDKSASTAYMELSSLRSEDTAVYYCARSFTTARAFAYWGQGTLVTVSSGKPGSGKPGSGKPGSGKPGSDIVMTQSPPTLSLSPGERVTLSCRASQSISDYLHWYQQKPGQSPRLLIKYASQSISGIPARFSGSGSGTDFTLTISSLEPEDFAVYYCQDGHSFPPTFGGGTKVEIK

SEQ ID NO: 490 - protein, 739 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFEYWGQGTLVTVSSGGGGSGGGGSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLSGGGGSEVQLVESGGGLVQPGGSLRLSCAASGFTFSDYWMSWVRQAPGKGLEWVADIKNDGSYTNYAPSLTNRFTISRDNAKNSLYLQMNSLRAEDTAVYYCARELTGTWGQGTMVTVSSGKPGSGKPGSGKPGSGKPGSDIVMTQSPDSLAVSLGERATINCKSSQSLLSSGNQKNYLAWYQQKPGQPPKLLIYYASTRQSGVPDRFSGSGSGTDFTLTISSLQAEDVAVYYCLQYDRYPFTFGQGTKLEIKEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 491 - protein, 738 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFEYWGQGTLVTVSSGGGGSGGGGSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLSGGGGSQVQLVQSGAEVKKPGASVKVSCKASGYTFSSYWMHWVRQAPGQRLEWMGEINPGNGHTNYSQKFQGRVTITVDKSASTAYMELSSLRSEDTAVYYCARSFTTARAFAYWGQGTLVTVSSGKPGSGKPGSGKPGSGKPGSDIVMTQSPPTLSLSPGERVTLSCRASQSISDYLHWYQQKPGQSPRLLIKYASQSISGIPARFSGSGSGTDFTLTISSLEPEDFAVYYCQDGHSFPPTFGGGTKVEIKEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 492 - protein, 746 aa, Artificial Sequence
  Description of Artificial Sequence: Synthetic polypeptide
QVQLVQSGAEVKKPGASVKVSCKASGYTFTNFGITWVRQAPGQGLEWMGEIYPSSGNTFYNEKFKGRVTMTTDTSTSTAYMELRSLRSDDTAVYYCARGGGPLRSRYFDYWGQGTLVTVSSGGGGSGGGGSGGGGSGGGGSDIVMTQSPDSLAVSLGERATINCRSSQSLFSSGNQKNYLTWYQQKPGQPPKLLIYWASTRESGVPDRFSGSGSGTDFTLTISSLQAEDVAVYYCQNDYYYPLTFGGGTKVEIKSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFEYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 493 - protein, 743 aa, Artificial Sequence
  Description of Artificial Sequence: Synthetic polypeptide
QVQLVQSGAEVKKPGASVKVSCKASGYTFTNSGMNWVRQAPGQGLEWMGWINTNTGEPTFAEEFRGRVTMTRDTSISTAYMELSRLRSDDTAVYYCARYYYGNSFAYWGQGTLVTVSSGGGGSGGGGSGGGGSGGGGSDIVMTQSPDSLAVSLGERATINCKSSQSLLNSGNQKNYLTWYQQKPGQPPKLLIYWASTRESGVPDRFSGSGSGTDFTLTISSLQAEDVAVYYCQNNYFYPLTFGGGTKVEIKSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFEYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 494 - protein, 961 aa, Artificial Sequence
  Description of Artificial Sequence: Synthetic polypeptide
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGKSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFEYWGQGTLVTVSSGGGGSGGGGSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLSGGGGSQVQLVQSGAEVKKPGASVKVSCKASGYTFTDYFMNWVRQAPGQGLEWMGVINPYNDITIYNQKFQGRVTMTVDRSTSTVYMELSSLRSEDTAVYYCAREGVLYDGYYEGAYWGQGTLVTVSSGGGGSGGGGSGGGGSDIQLTQSPSFLSASVGDRVTITCKASQNVGIAVAWYQQKPGKAPKLLIYAASNRYTGVPSRFSGSGSGTEFTLTISSLQPEDFATYYCQQYSTYPYTFGQGTKLEIK

SEQ ID NO: 495 - protein, 709 aa, Artificial Sequence
  Description of Artificial Sequence: Synthetic polypeptide
QVQLVQSGAEVKKPGASVKVSCKASGYTFSSYWMHWVRQAPGQRLEWMGEINPGNGHTNYSQKFQGRVTITVDKSASTAYMELSSLRSEDTAVYYCARSFTTARAFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVCTLPPSRDELTKNQVSLTCLVEGFYPSDIAVEWESNGQPENNYKTTPPVLDSDGSFFLYSDLTVDKSRWQQGNVFSCSVMHEALHNHYTQESLSLSPGKSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFEYWGQGTLVTVSSGGGGSGGGGSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 496 - protein, 959 aa, Artificial Sequence
  Description of Artificial Sequence: Synthetic polypeptide
QVQLVQSGAEVKKPGASVKVSCKASGYTFSSYWMHWVRQAPGQRLEWMGEINPGNGHTNYSQKFQGRVTITVDKSASTAYMELSSLRSEDTAVYYCARSFTTARAFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVCTLPPSRDELTKNQVSLTCLVEGFYPSDIAVEWESNGQPENNYKTTPPVLDSDGSFFLYSDLTVDKSRWQQGNVFSCSVMHEALHNHYTQESLSLSPGKSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFEYWGQGTLVTVSSGGGGSGGGGSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLSGGGGSQVQLVQSGAEVKKPGASVKVSCKASGYTFTDYFMNWVRQAPGQGLEWMGVINPYNDITIYNQKFQGRVTMTVDRSTSTVYMELSSLRSEDTAVYYCAREGVLYDGYYEGAYWGQGTLVTVSSGGGGSGGGGSGGGGSDIQLTQSPSFLSASVGDRVTITCKASQNVGIAVAWYQQKPGKAPKLLIYAASNRYTGVPSRFSGSGSGTEFTLTISSLQPEDFATYYCQQYSTYPYTFGQGTKLEIK

SEQ ID NO: 497 - protein, 986 aa, Artificial Sequence
  Description of Artificial Sequence: Synthetic polypeptide
QVQLVQSGAEVKKPGASVKVSCKASGYTFTDYFMNWVRQAPGQGLEWMGVINPYNDITIYNQKFQGRVTMTVDRSTSTVYMELSSLRSEDTAVYYCAREGVLYDGYYEGAYWGQGTLVTVSSGGGGSGGGGSGGGGSDIQLTQSPSFLSASVGDRVTITCKASQNVGIAVAWYQQKPGKAPKLLIYAASNRYTGVPSRFSGSGSGTEFTLTISSLQPEDFATYYCQQYSTYPYTFGQGTKLEIKSGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFEYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGKSGGGSQVQLVQSGAEVKKPGASVKVSCKASGYTFSSYWMHWVRQAPGQRLEWMGEINPGNGHTNYSQKFQGRVTITVDKSASTAYMELSSLRSEDTAVYYCARSFTTARAFAYWGQGTLVTVSSGKPGSGKPGSGKPGSGKPGSDIVMTQSPPTLSLSPGERVTLSCRASQSISDYLHWYQQKPGQSPRLLIKYASQSISGIPARFSGSGSGTDFTLTISSLEPEDFAVYYCQDGHSFPPTFGGGTKVEIK

SEQ ID NO: 498 - protein, 703 aa, Artificial Sequence
  Description of Artificial Sequence: Synthetic polypeptide
QVQLVQSGAEVKKPGASVKVSCKASGYTFTDYFMNWVRQAPGQGLEWMGVINPYNDITIYNQKFQGRVTMTVDRSTSTVYMELSSLRSEDTAVYYCAREGVLYDGYYEGAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVCTLPPSRDELTKNQVSLTCLVEGFYPSDIAVEWESNGQPENNYKTTPPVLDSDGSFFLYSDLTVDKSRWQQGNVFSCSVMHEALHNHYTQESLSLSPGKSGGGSQVQLVQSGAEVKKPGASVKVSCKASGYTFSSYWMHWVRQAPGQRLEWMGEINPGNGHTNYSQKFQGRVTITVDKSASTAYMELSSLRSEDTAVYYCARSFTTARAFAYWGQGTLVTVSSGKPGSGKPGSGKPGSGKPGSDIVMTQSPPTLSLSPGERVTLSCRASQSISDYLHWYQQKPGQSPRLLIKYASQSISGIPARFSGSGSGTDFTLTISSLEPEDFAVYYCQDGHSFPPTFGGGTKVEIK

SEQ ID NO: 499 - protein, 954 aa, Artificial Sequence
  Description of Artificial Sequence: Synthetic polypeptide
QVQLVQSGAEVKKPGASVKVSCKASGYTFTDYFMNWVRQAPGQGLEWMGVINPYNDITIYNQKFQGRVTMTVDRSTSTVYMELSSLRSEDTAVYYCAREGVLYDGYYEGAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVCTLPPSRDELTKNQVSLTCLVEGFYPSDIAVEWESNGQPENNYKTTPPVLDSDGSFFLYSDLTVDKSRWQQGNVFSCSVMHEALHNHYTQESLSLSPGKSGGGSQVQLVQSGAEVKKPGASVKVSCKASGYTFSSYWMHWVRQAPGQRLEWMGEINPGNGHTNYSQKFQGRVTITVDKSASTAYMELSSLRSEDTAVYYCARSFTTARAFAYWGQGTLVTVSSGKPGSGKPGSGKPGSGKPGSDIVMTQSPPTLSLSPGERVTLSCRASQSISDYLHWYQQKPGQSPRLLIKYASQSISGIPARFSGSGSGTDFTLTISSLEPEDFAVYYCQDGHSFPPTFGGGTKVEIKSGGGSQVQLVQSGAEVKKPGASVKVSCKASGYTFSSYWMHWVRQAPGQRLEWMGEINPGNGHTNYSQKFQGRVTITVDKSASTAYMELSSLRSEDTAVYYCARSFTTARAFAYWGQGTLVTVSSGKPGSGKPGSGKPGSGKPGSDIVMTQSPPTLSLSPGERVTLSCRASQSISDYLHWYQQKPGQSPRLLIKYASQSISGIPARFSGSGSGTDFTLTISSLEPEDFAVYYCQDGHSFPPTFGGGTKVEIK

SEQ ID NO: 500 - protein, 731 aa, Artificial Sequence
  Description of Artificial Sequence: Synthetic polypeptide
QVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSSGGGGSGGGGSGGGGSGGGGSDIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKSGGGGSQVQLVQSGAEVKKPGASVKVSCKASGYTFSSYWMHWVRQAPGQRLEWMGEINPGNGHTNYSQKFQGRVTITVDKSASTAYMELSSLRSEDTAVYYCARSFTTARAFAYWGQGTLVTVSSGKPGSGKPGSGKPGSGKPGSDIVMTQSPPTLSLSPGERVTLSCRASQSISDYLHWYQQKPGQSPRLLIKYASQSISGIPARFSGSGSGTDFTLTISSLEPEDFAVYYCQDGHSFPPTFGGGTKVEIKEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 501 - protein, 732 aa, Artificial Sequence
  Description of Artificial Sequence: Synthetic polypeptide
QVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSSGGGGSGGGGSGGGGSGGGGSDIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKSGGGGSEVQLVESGGGLVQPGGSLRLSCAASGFTFSDYWMSWVRQAPGKGLEWVADIKNDGSYTNYAPSLTNRFTISRDNAKNSLYLQMNSLRAEDTAVYYCARELTGTWGQGTMVTVSSGKPGSGKPGSGKPGSGKPGSDIVMTQSPDSLAVSLGERATINCKSSQSLLSSGNQKNYLAWYQQKPGQPPKLLIYYASTRQSGVPDRFSGSGSGTDFTLTISSLQAEDVAVYYCLQYDRYPFTFGQGTKLEIKEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 502 - protein, 731 aa, Artificial Sequence
  Description of Artificial Sequence: Synthetic polypeptide
QVQLVQSGAEVKKPGASVKVSCKASGYTFSSYWMHWVRQAPGQRLEWMGEINPGNGHTNYSQKFQGRVTITVDKSASTAYMELSSLRSEDTAVYYCARSFTTARAFAYWGQGTLVTVSSGGGGSGGGGSGGGGSGGGGSDIVMTQSPPTLSLSPGERVTLSCRASQSISDYLHWYQQKPGQSPRLLIKYASQSISGIPARFSGSGSGTDFTLTISSLEPEDFAVYYCQDGHSFPPTFGGGTKVEIKSGGGGSQVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSSGKPGSGKPGSGKPGSGKPGSDIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 503 - protein, 732 aa, Artificial Sequence
  Description of Artificial Sequence: Synthetic polypeptide
EVQLVESGGGLVQPGGSLRLSCAASGFTFSDYWMSWVRQAPGKGLEWVADIKNDGSYTNYAPSLTNRFTISRDNAKNSLYLQMNSLRAEDTAVYYCARELTGTWGQGTMVTVSSGGGGSGGGGSGGGGSGGGGSDIVMTQSPDSLAVSLGERATINCKSSQSLLSSGNQKNYLAWYQQKPGQPPKLLIYYASTRQSGVPDRFSGSGSGTDFTLTISSLQAEDVAVYYCLQYDRYPFTFGQGTKLEIKSGGGGSQVQLVQSGAEVKKPGASVKVSCKASGYTFTSYYIHWVRQAPGQGLEWIGSIYPGNVNTNYNEKFKDRATLTVDTSISTAYMELSRLRSDDTAVYFCTRSHYGLDWNFDVWGQGTTVTVSSGKPGSGKPGSGKPGSGKPGSDIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKEPKSSDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPCRKKLTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 504 - protein, 5 aa, Artificial Sequence
  Description of Artificial Sequence: Synthetic peptide
GGGGS

SEQ ID NO: 505 - protein, 5 aa, Artificial Sequence
  Description of Artificial Sequence: Synthetic peptide
GKPGS

SEQ ID NO: 506 - protein, 5 aa, Artificial Sequence
  Description of Artificial Sequence: Synthetic peptide
GEPGS

SEQ ID NO: 507 - protein, 5 aa, Artificial Sequence
  Description of Artificial Sequence: Synthetic peptide
GGPGS

SEQ ID NO: 508 - protein, 20 aa, Artificial Sequence
  Description of Artificial Sequence: Synthetic peptide
GKPGSGKPGSGKPGSGKPGS

SEQ ID NO: 509 - protein, 20 aa, Artificial Sequence
  Description of Artificial Sequence: Synthetic peptide
GGGGSGGGGSGGGGSGGGGS

The invention claimed is:

1. A trispecific molecule that binds Cldn18.2, CD28 and CD3 comprised of: a) an anti-Cldn18.2 antibody comprising a first chain of SEQ ID NO: 406 and a second chain of SEQ ID NO: 413; and b) a first antigen binding entity and a second antigen binding entity which bind CD28 and CD3 comprising a third chain of SEQ ID NO: 481.

2. The trispecific molecule of claim 1, wherein the first antigen binding entity and the second antigen binding entity form a heterodimer configuration.

3. A method of treating cancer comprising administering to a subject in need thereof an effective amount of the trispecific molecule of claim 1.

4. The method of claim 3, wherein the cancer is at least one of lung, pancreatic, appendiceal and colon cancer.

* * * * *